United States Patent 11,912,985 (METHODS AND COMPOSITIONS FOR SIMULTANEOUS EDITING OF BOTH STRANDS OF A TARGET DOUBLE-STRANDED NUCLEOTIDE SEQUENCE) - sequence listing, part 2

SEQ ID NO: 1133 - protein, 15 aa, synthetic construct
  REGION 1..15: note = Synthetic
GSPNCHGPDWASPVC

SEQ ID NO: 1134 - protein, 15 aa, synthetic construct
  REGION 1..15: note = Synthetic
GSQARKCGLHIRAGP

SEQ ID NO: 1135 - protein, 15 aa, synthetic construct
  REGION 1..15: note = Synthetic
GSSNSAFVSTSSSRR

SEQ ID NO: 1136 - protein, 15 aa, synthetic construct
  REGION 1..15: note = Synthetic
GSTKSCARTLVSGSF

SEQ ID NO: 1137 - protein, 15 aa, synthetic construct
  REGION 1..15: note = Synthetic
GSYYKQYHPTACEVE

SEQ ID NO: 1138 - protein, 15 aa, synthetic construct
  REGION 1..15: note = Synthetic
GTHTTAVSETRQTWA

SEQ ID NO: 1139 - protein, 15 aa, synthetic construct
  REGION 1..15: note = Synthetic
GTIINQDPDKILTYI

SEQ ID NO: 1140 - protein, 11 aa, synthetic construct
  REGION 1..11: note = Synthetic
GTLVRMAPVIG

SEQ ID NO: 1141 - protein, 13 aa, synthetic construct
  REGION 1..13: note = Synthetic
GTPLDIDTASESS

SEQ ID NO: 1142 - protein, 28 aa, synthetic construct
  REGION 1..28: note = Synthetic
GTYLGQAYGGIIKDAPPGAGFIYRETFC

SEQ ID NO: 1143 - protein, 17 aa, synthetic construct
  REGION 1..17: note = Synthetic
GVATKGLGVHAKSSDWG

SEQ ID NO: 1144 - protein, 20 aa, synthetic construct
  REGION 1..20: note = Synthetic
GVLLPTIPGKLDVNKSKTHI

SEQ ID NO: 1145 - protein, 15 aa, synthetic construct
  REGION 1..15: note = Synthetic
GVLSVDLSLTVELKI

SEQ ID NO: 1146 - protein, 15 aa, synthetic construct
  REGION 1..15: note = Synthetic
GVPIELQVECFTWDQ

SEQ ID NO: 1147 - protein, 15 aa, synthetic construct
  REGION 1..15: note = Synthetic
GVSCTVTREDGTNRR

SEQ ID NO: 1148 - protein, 15 aa, synthetic construct
  REGION 1..15: note = Synthetic
GVSYNIGSQEWYTTV

SEQ ID NO: 1149 - protein, 15 aa, synthetic construct
  REGION 1..15: note = Synthetic
GYNVSSIVTMTSQGM

SEQ ID NO: 1150 - protein, 15 aa, synthetic construct
  REGION 1..15: note = Synthetic
HFCVLADSESGGHIT

SEQ ID NO: 1151 - protein, 15 aa, synthetic construct
  REGION 1..15: note = Synthetic
HGEDSITIPYQGSGK

SEQ ID NO: 1152 - protein, 8 aa, synthetic construct
  REGION 1..8: note = Synthetic
HGPDWASP

SEQ ID NO: 1153 - protein, 15 aa, synthetic construct
  REGION 1..15: note = Synthetic
HGPDWASPVCQRHSP

SEQ ID NO: 1154 - protein, 22 aa, synthetic construct
  REGION 1..22: note = Synthetic
HGPDWASPVCQRHSPDCSRLVG

SEQ ID NO: 1155 - protein, 33 aa, synthetic construct
  REGION 1..33: note = Synthetic
HGPDWASPVCQRHSPDCSRLVGATPERPRLRLV

SEQ ID NO: 1156 - protein, 15 aa, synthetic construct
  REGION 1..15: note = Synthetic
HITHSGMEGMGVSCT

SEQ ID NO: 1157 - protein, 15 aa, synthetic construct
  REGION 1..15: note = Synthetic
HKSLSTNLDVTNSIE

SEQ ID NO: 1158 - protein, 9 aa, synthetic construct
  REGION 1..9: note = Synthetic
HLMIDRPYV

SEQ ID NO: 1159 - protein, 13 aa, synthetic construct
  REGION 1..13: note = Synthetic
HLPTGTPLDIDTA

SEQ ID NO: 1160 - protein, 24 aa, synthetic construct
  REGION 1..24: note = Synthetic
HLPTGTPLDIDTATESSQDPQDSR

SEQ ID NO: 1161 - protein, 15 aa, synthetic construct
  REGION 1..15: note = Synthetic
HMTNYLEQPVSNDLS

SEQ ID NO: 1162 - protein, 15 aa, synthetic construct
  REGION 1..15: note = Synthetic
HQSLVIKLMPNITLL

SEQ ID NO: 1163 - protein, 15 aa, synthetic construct
  REGION 1..15: note = Synthetic
HRAAIYTAEIHKSLS

SEQ ID NO: 1164 - protein, 18 aa, synthetic construct
  REGION 1..18: note = Synthetic
HRMQEAVEAERAGRGTGH

SEQ ID NO: 1165 - protein, 15 aa, synthetic construct
  REGION 1..15: note = Synthetic
HVDTESYFIVLSIAY

SEQ ID NO: 1166 - protein, 15 aa, synthetic construct
  REGION 1..15: note = Synthetic
HWGNLSKIGVVGIGS

SEQ ID NO: 1167 - protein, 15 aa, synthetic construct
  REGION 1..15: note = Synthetic
HWWQLTLGATCALPL

SEQ ID NO: 1168 - protein, 23 aa, synthetic construct
  REGION 1..23: note = Synthetic
HYRNASDVLPGHWLQGGWGCYNL

SEQ ID NO: 1169 - protein, 15 aa, synthetic construct
  REGION 1..15: note = Synthetic
IDLGPPISLERLDVG

SEQ ID NO: 1170 - protein, 15 aa, synthetic construct
  REGION 1..15: note = Synthetic
IEAIRQAGQEMILAV

SEQ ID NO: 1171 - protein, 9 aa, synthetic construct
  REGION 1..9: note = Synthetic
IETRSARHP

SEQ ID NO: 1172 - protein, 15 aa, synthetic construct
  REGION 1..15: note = Synthetic
IGSQEWYTTVPKYVA

SEQ ID NO: 1173 - protein, 15 aa, synthetic construct
  REGION 1..15: note = Synthetic
IKGVIVHRLEGVSYN

SEQ ID NO: 1174 - protein, 15 aa, synthetic construct
  REGION 1..15: note = Synthetic
IKHIIIVPIPGDSSI

SEQ ID NO: 1175 - protein, 20 aa, synthetic construct
  REGION 1..20: note = Synthetic
IKHIIIVPIPGDSSITTRSR

SEQ ID NO: 1176 - protein, 7 aa, synthetic construct
  REGION 1..7: note = Synthetic
IKLKDCP

SEQ ID NO: 1177 - protein, 15 aa, synthetic construct
  REGION 1..15: note = Synthetic
IKLMPNITLLNNCTR

SEQ ID NO: 1178 - protein, 10 aa, synthetic construct
  REGION 1..10: note = Synthetic
ILLERLDVGT

SEQ ID NO: 1179 - protein, 10 aa, synthetic construct
  REGION 1..10: note = Synthetic
ILPGQDLQYV

SEQ ID NO: 1180 - protein, 15 aa, synthetic construct
  REGION 1..15: note = Synthetic
ILTYIAADHCPVVEV

SEQ ID NO: 1181 - protein, 11 aa, synthetic construct
  REGION 1..11: note = Synthetic
INQDPDKILTY

SEQ ID NO: 1182 - protein, 15 aa, synthetic construct
  REGION 1..15: note = Synthetic
IPRFKVSPYLFNVPI

SEQ ID NO: 1183 - protein, 15 aa, synthetic construct
  REGION 1..15: note = Synthetic
IQALSYALGGDINKV

SEQ ID NO: 1184 - protein, 15 aa, synthetic construct
  REGION 1..15: note = Synthetic
IRAGPYGHATVEMPE

SEQ ID NO: 1185 - protein, 7 aa, synthetic construct
  REGION 1..7: note = Synthetic
IRMGTDK

SEQ ID NO: 1186 - protein, 15 aa, synthetic construct
  REGION 1..15: note = Synthetic
ISNFDESSCTFMPEG

SEQ ID NO: 1187 - protein, 15 aa, synthetic construct
  REGION 1..15: note = Synthetic
ITAGIALHQSMLNSQ

SEQ ID NO: 1188 - protein, 15 aa, synthetic construct
  REGION 1..15: note = Synthetic
ITDDPDVSIRLLEVV

SEQ ID NO: 1189 - protein, 20 aa, synthetic construct
  REGION 1..20: note = Synthetic
ITDDPDVSIRLLEVVQSDQS

SEQ ID NO: 1190 - protein, 5 aa, synthetic construct
  REGION 1..5: note = Synthetic
ITTYV

SEQ ID NO: 1191 - protein, 15 aa, synthetic construct
  REGION 1..15: note = Synthetic
IVEAGLASFILTIKF

SEQ ID NO: 1192 - protein, 20 aa, synthetic construct
  REGION 1..20: note = Synthetic
IVEAGLASFILTIKFGIETM

SEQ ID NO: 1193 - protein, 25 aa, synthetic construct
  REGION 1..25: note = Synthetic
IVEAGLASFILTIKFGIETMYPALG

SEQ ID NO: 1194 - protein, 16 aa, synthetic construct
  REGION 1..16: note = Synthetic
KALEAQSRALRAELAA

SEQ ID NO: 1195 - protein, 15 aa, synthetic construct
  REGION 1..15: note = Synthetic
KARITHVDTESYFIV

SEQ ID NO: 1196 - protein, 15 aa, synthetic construct
  REGION 1..15: note = Synthetic
KCGLHIRAGPYGHAT

SEQ ID NO: 1197 - protein, 15 aa, synthetic construct
  REGION 1..15: note = Synthetic
KCYTTGTIINQDPDK

SEQ ID NO: 1198 - protein, 10 aa, synthetic construct
  REGION 1..10: note = Synthetic
KDNPHPKGSR

SEQ ID NO: 1199 - protein, 15 aa, synthetic construct
  REGION 1..15: note = Synthetic
KDNRIPSYGVLSVDL

SEQ ID NO: 1200 - protein, 15 aa, synthetic construct
  REGION 1..15: note = Synthetic
KFLNPDREYDFRDLT

SEQ ID NO: 1201 - protein, 9 aa, synthetic construct
  REGION 1..9: note = Synthetic
KFVTAALLN

SEQ ID NO: 1202 - protein, 11 aa, synthetic construct
  REGION 1..11: note = Synthetic
KGNCSGPTTIR

SEQ ID NO: 1203 - protein, 15 aa, synthetic construct
  REGION 1..15: note = Synthetic
KIKFLNPDREYDFRD

SEQ ID NO: 1204 - protein, 15 aa, synthetic construct
  REGION 1..15: note = Synthetic
KIVDGGCFAPWDLEA

SEQ ID NO: 1205 - protein, 15 aa, synthetic construct
  REGION 1..15: note = Synthetic
KLGLKLLRYYTEILS

SEQ ID NO: 1206 - protein, 15 aa, synthetic construct
  REGION 1..15: note = Synthetic
KLGVWKSPTDMQSWV

SEQ ID NO: 1207 - protein, 7 aa, synthetic construct
  REGION 1..7: note = Synthetic
KLKECPQ

SEQ ID NO: 1208 - protein, 9 aa, synthetic construct
  REGION 1..9: note = Synthetic
KLLRYYTEI

SEQ ID NO: 1209 - protein, 10 aa, synthetic construct
  REGION 1..10: note = Synthetic
KLMPFSGDFV

SEQ ID NO: 1210 - protein, 9 aa, synthetic construct
  REGION 1..9: note = Synthetic
KLMPNITLL

SEQ ID NO: 1211 - protein, 26 aa, synthetic construct
  REGION 1..26: note = Synthetic
KLRMETCFQQACKGKIQALCENPEWA

SEQ ID NO: 1212 - protein, 9 aa, synthetic construct
  REGION 1..9: note = Synthetic
KLWCRHFCV

SEQ ID NO: 1213 - protein, 10 aa, synthetic construct
  REGION 1..10: note = Synthetic
KLWCRHFCVL

SEQ ID NO: 1214 - protein, 9 aa, synthetic construct
  REGION 1..9: note = Synthetic
KLWESPQEI

SEQ ID NO: 1215 - protein, 9 aa, synthetic construct
  REGION 1..9: note = Synthetic
KMSSAVGFV

SEQ ID NO: 1216 - protein, 17 aa, synthetic construct
  REGION 1..17: note = Synthetic
KMSSAVGFVPDTGPASR

SEQ ID NO: 1217 - protein, 7 aa, synthetic construct
  REGION 1..7: note = Synthetic
KMVYATN

SEQ ID NO: 1218 - protein, 15 aa, synthetic construct
  REGION 1..15: note = Synthetic
KPDLTGTSKSYVRSL

SEQ ID NO: 1219 - protein, 15 aa, synthetic construct
  REGION 1..15: note = Synthetic
KPNLSSKRSELSQLS

SEQ ID NO: 1220 - protein, 20 aa, synthetic construct
  REGION 1..20: note = Synthetic
KPNLSSKRSELSQLSMYRVF

SEQ ID NO: 1221 - protein, 15 aa, synthetic construct
  REGION 1..15: note = Synthetic
KQSRGEARESYRETG

SEQ ID NO: 1222 - protein, 20 aa, synthetic construct
  REGION 1..20: note = Synthetic
KQSRGEARESYRETGPSRAS

SEQ ID NO: 1223 - protein, 15 aa, synthetic construct
  REGION 1..15: note = Synthetic
KRFAGVVLAGAALGV

SEQ ID NO: 1224 - protein, 15 aa, synthetic construct
  REGION 1..15: note = Synthetic
KRTPGNKPRIAEMIC

SEQ ID NO: 1225 - protein, 20 aa, synthetic construct
  REGION 1..20: note = Synthetic
KRTPGNKPRIAEMICDIDTY

SEQ ID NO: 1226 - protein, 26 aa, synthetic construct
  REGION 1..26: note = Synthetic
KSNHNNVYWLTIPPMKNLALGVINTL

SEQ ID NO: 1227 - protein, 9 aa, synthetic construct
  REGION 1..9: note = Synthetic
KVSPYLFNV

SEQ ID NO: 1228 - protein, 17 aa, synthetic construct
  REGION 1..17: note = Synthetic
KVVQLPKISKNALKANG

SEQ ID NO: 1229 - protein, 17 aa, synthetic construct
  REGION 1..17: note = Synthetic
KVVQLPKISKNALRNDG

SEQ ID NO: 1230 - protein, 12 aa, synthetic construct
  REGION 1..12: note = Synthetic
LAHRRIPPENIR

SEQ ID NO: 1231 - protein, 12 aa, synthetic construct
  REGION 1..12: note = Synthetic
LALALWAGFALS

SEQ ID NO: 1232 - protein, 15 aa, synthetic construct
  REGION 1..15: note = Synthetic
LAPGGGNCHLTVNGE

SEQ ID NO: 1233 - protein, 15 aa, synthetic construct
  REGION 1..15: note = Synthetic
LAQIWVLLAKAVTAP

SEQ ID NO: 1234 - protein, 20 aa, synthetic construct
  REGION 1..20: note = Synthetic
LAQIWVLLAKAVTAPDTAAD

SEQ ID NO: 1235 - protein, 29 aa, synthetic construct
  REGION 1..29: note = Synthetic
LASYFNPGGSYYKQYHPTACEVEPAFGHS

SEQ ID NO: 1236 - protein, 15 aa, synthetic construct
  REGION 1..15: note = Synthetic
LAVSKGNCSGPTTIR

SEQ ID NO: 1237 - protein, 15 aa, synthetic construct
  REGION 1..15: note = Synthetic
LCENPEWAPLKDNRI

SEQ ID NO: 1238 - protein, 9 aa, synthetic construct
  REGION 1..9: note = Synthetic
LDRLVRLIG

SEQ ID NO: 1239 - protein, 9 aa, synthetic construct
  REGION 1..9: note = Synthetic
LEEEGVTPL

SEQ ID NO: 1240 - protein, 22 aa, synthetic construct
  REGION 1..22: note = Synthetic
LEHRMQEAVEAERAGRGTGHFI

SEQ ID NO: 1241 - protein, 15 aa, synthetic construct
  REGION 1..15: note = Synthetic
LEKLGYSGGDLLGIL

SEQ ID NO: 1242 - protein, 10 aa, synthetic construct
  REGION 1..10: note = Synthetic
LEQPVSNDLS

SEQ ID NO: 1243 - protein, 15 aa, synthetic construct
  REGION 1..15: note = Synthetic
LERKWLDVVRNIIAE

SEQ ID NO: 1244 - protein, 20 aa, synthetic construct
  REGION 1..20: note = Synthetic
LERKWLDVVRNIIAEDLSLR

SEQ ID NO: 1245 - protein, 15 aa, synthetic construct
  REGION 1..15: note = Synthetic
LFGPSLRDPISAEIS

SEQ ID NO: 1246 - protein, 15 aa, synthetic construct
  REGION 1..15: note = Synthetic
LGELKLAALCHGEDS

SEQ ID NO: 1247 - protein, 13 aa, synthetic construct
  REGION 1..13: note = Synthetic
LGGKEDRRVKQSR

SEQ ID NO: 1248 - protein, 24 aa, synthetic construct
  REGION 1..24: note = Synthetic
LGHDGHHGGTLRVGQHHRNASDVL

SEQ ID NO: 1249 - protein, 20 aa, synthetic construct
  REGION 1..20: note = Synthetic
LGSPNCHGPDWASPVCQRHS

SEQ ID NO: 1250 - protein, 27 aa, synthetic construct
  REGION 1..27: note = Synthetic
LGSPNCHGPDWASPVCQRHSPDCSRLV

SEQ ID NO: 1251 - protein, 18 aa, synthetic construct
  REGION 1..18: note = Synthetic
LHDPDTEAPTEACVTSWL

SEQ ID NO: 1252 - protein, 15 aa, synthetic construct
  REGION 1..15: note = Synthetic
LIANCASILCKCYTT

SEQ ID NO: 1253 - protein, 24 aa, synthetic construct
  REGION 1..24: note = Synthetic
LIGLLAIAGIRLHRAAIYTAEIHK

SEQ ID NO: 1254 - protein, 15 aa, synthetic construct
  REGION 1..15: note = Synthetic
LIPSMNQLSCDLIGQ

SEQ ID NO: 1255 - protein, 15 aa, synthetic construct
  REGION 1..15: note = Synthetic
LKIKIASGFGPLITH

SEQ ID NO: 1256 - protein, 23 aa, synthetic construct
  REGION 1..23: note = Synthetic
LKIKIASGFGPLITHGSGMDLYK

SEQ ID NO: 1257 - protein, 7 aa, synthetic construct
  REGION 1..7: note = Synthetic
LKLYFEP

SEQ ID NO: 1258 - protein, 10 aa, synthetic construct
  REGION 1..10: note = Synthetic
LLAVLFVMFL

SEQ ID NO: 1259 - protein, 15 aa, synthetic construct
  REGION 1..15: note = Synthetic
LLDRLVRLIGNPDVS

SEQ ID NO: 1260 - protein, 20 aa, synthetic construct
  REGION 1..20: note = Synthetic
LLDRLVRLIGNPDVSGPKLT

SEQ ID NO: 1261 - protein, 15 aa, synthetic construct
  REGION 1..15: note = Synthetic
LLESSDQILRSMKGL

SEQ ID NO: 1262 - protein, 15 aa, synthetic construct
  REGION 1..15: note = Synthetic
LLETRTTNQFLAVSK

SEQ ID NO: 1263 - protein, 15 aa, synthetic construct
  REGION 1..15: note = Synthetic
LLEVVQSDQSQSGLT

SEQ ID NO: 1264 - protein, 19 aa, synthetic construct
  REGION 1..19: note = Synthetic
LLEVVQSDQSQSGLTFASR

SEQ ID NO: 1265 - protein, 20 aa, synthetic construct
  REGION 1..20: note = Synthetic
LLEVVQSDQSQSGLTFASRG

SEQ ID NO: 1266 - protein, 15 aa, synthetic construct
  REGION 1..15: note = Synthetic
LLGILESRGIKARIT

SEQ ID NO: 1267 - protein, 8 aa, synthetic construct
  REGION 1..8: note = Synthetic
LLRTAPGP

SEQ ID NO: 1268 - protein, 15 aa, synthetic construct
  REGION 1..15: note = Synthetic
LLRYYTEILSLFGPS

SEQ ID NO: 1269 - protein, 20 aa, synthetic construct
  REGION 1..20: note = Synthetic
LLVPWVLIFMVCRRACRRRG

SEQ ID NO: 1270 - protein, 10 aa, synthetic construct
  REGION 1..10: note = Synthetic
LLWRSRCKIV

SEQ ID NO: 1271 - protein, 9 aa, synthetic construct
  REGION 1..9: note = Synthetic
LLWSYAMGV

SEQ ID NO: 1272 - protein, 15 aa, synthetic construct
  REGION 1..15: note = Synthetic
LLWSYAMGVGVELEN

SEQ ID NO: 1273 - protein, 20 aa, synthetic construct
  REGION 1..20: note = Synthetic
LLWSYAMGVGVELENSMGGL

SEQ ID NO: 1274 - protein, 9 aa, synthetic construct
  REGION 1..9: note = Synthetic
LMIDRPYVL

SEQ ID NO: 1275 - protein, 15 aa, synthetic construct
  REGION 1..15: note = Synthetic
LNAMTQNIRPVQSVA

SEQ ID NO: 1276 - protein, 15 aa, synthetic construct
  REGION 1..15: note = Synthetic
LNTPPPYQVSCGGES

SEQ ID NO: 1277 - protein, 15 aa, synthetic construct
  REGION 1..15: note = Synthetic
LRDPISAEISIQALS

SEQ ID NO: 1278 - protein, 16 aa, synthetic construct
  REGION 1..16: note = Synthetic
LRGSGDLQEYLRHVTR

SEQ ID NO: 1279 - protein, 8 aa, synthetic construct
  REGION 1..8: note = Synthetic
LRLVDADD

SEQ ID NO: 1280 - protein, 12 aa, synthetic construct
  REGION 1..12: note = Synthetic
LRLVDADDPLLR

SEQ ID NO: 1281 - protein, 31 aa, synthetic construct
  REGION 1..31: note = Synthetic
LRLVDADDPLLRTAPGPGEVWVTPVIGSQAR

SEQ ID NO: 1282 - protein, 28 aa, synthetic construct
  REGION 1..28: note = Synthetic
LRRLLYMIYMSGLAVRVHVSKEEQYYDY

SEQ ID NO: 1283 - protein, 8 aa, synthetic construct
  REGION 1..8: note = Synthetic
LRTAPGPG

SEQ ID NO: 1284 - protein, 20 aa, synthetic construct
  REGION 1..20: note = Synthetic
LRVGQHYRNASDVLPGHWLQ

SEQ ID NO: 1285 - protein, 5 aa, synthetic construct
  REGION 1..5: note = Synthetic
LRYLA

SEQ ID NO: 1286 - protein, 13 aa, synthetic construct
  REGION 1..13: note = Synthetic
LSCKPWQESRKNK

SEQ ID NO: 1287 - protein, 15 aa, synthetic construct
  REGION 1..15: note = Synthetic
LSEIKGVIVHRLEGV

SEQ ID NO: 1288 - protein, 15 aa, synthetic construct
  REGION 1..15: note = Synthetic
LSIAYPTLSEIKGVI

SEQ ID NO: 1289 - protein, 15 aa, synthetic construct
  REGION 1..15: note = Synthetic
LSLLDLYLGRGYNVS

SEQ ID NO: 1290 - protein, 15 aa, synthetic construct
  REGION 1..15: note = Synthetic
LSQGNLIANCASILC

SEQ ID NO: 1291 - protein, 15 aa, synthetic construct
  REGION 1..15: note = Synthetic
LSSHRGVIADNQAKW

SEQ ID NO: 1292 - protein, 15 aa, synthetic construct
  REGION 1..15: note = Synthetic
LSVDLSLTVELKIKI

SEQ ID NO: 1293 - protein, 14 aa, synthetic construct
  REGION 1..14: note = Synthetic
LTGISICNPGSSLC

SEQ ID NO: 1294 - protein, 15 aa, synthetic construct
  REGION 1..15: note = Synthetic
LTIKFGIETMYPALG

SEQ ID NO: 1295 - protein, 20 aa, synthetic construct
  REGION 1..20: note = Synthetic
LTIKFGIETMYPALGLHEFA

SEQ ID NO: 1296 - protein, 15 aa, synthetic construct
  REGION 1..15: note = Synthetic
LTLQTPTGQIHWGNL

SEQ ID NO: 1297 - protein, 8 aa, synthetic construct
  REGION 1..8: note = Synthetic
LVDADDPL

SEQ ID NO: 1298 - protein, 10 aa, synthetic construct
  REGION 1..10: note = Synthetic
LVDADDPLLR

SEQ ID NO: 1299 - protein, 15 aa, synthetic construct
  REGION 1..15: note = Synthetic
LVEKPNLSSKRSELS

SEQ ID NO: 1300 - protein, 7 aa, synthetic construct
  REGION 1..7: note = Synthetic
LVGATPE

SEQ ID NO: 1301 - protein, 8 aa, synthetic construct
  REGION 1..8: note = Synthetic
LVGATPER

SEQ ID NO: 1302 - protein, 15 aa, synthetic construct
  REGION 1..15: note = Synthetic
LVKLGVWKSPTGMQS

SEQ ID NO: 1303 - protein, 18 aa, synthetic construct
  REGION 1..18: note = Synthetic
LVSGSFGNRFILSQGNLI

SEQ ID NO: 1304 - protein, 15 aa, synthetic construct
  REGION 1..15: note = Synthetic
LYKSNHNNVYWLTIP

SEQ ID NO: 1305 - protein, 25 aa, synthetic construct
  REGION 1..25: note = Synthetic
LYPMSPLLQECLRGSTKSCARTLVS

SEQ ID NO: 1306 - protein, 18 aa, synthetic construct
  REGION 1..18: note = Synthetic
MASTTPITMEDLQKALEA

SEQ ID NO: 1307 - protein, 21 aa, synthetic construct
  REGION 1..21: note = Synthetic
MASTTPITMEDLQKALEAQSR

SEQ ID NO: 1308 - protein, 29 aa, synthetic construct
  REGION 1..29: note = Synthetic
MASTTPITMEDLQKALEAQSRALRAELAA

SEQ ID NO: 1309 - protein, 29 aa, synthetic construct
  REGION 1..29: note = Synthetic
MASTTPITMEDLQKALEAQSRALRAGLAA

SEQ ID NO: 1310 - protein, 29 aa, synthetic construct
  REGION 1..29: note = Synthetic
MASTTPITMEDLQKALETQSRVLRAGLTA

SEQ ID NO: 1311 - protein, 15 aa, synthetic construct
  REGION 1..15: note = Synthetic
MATLLRSLALFKRNK

SEQ ID NO: 1312 - protein, 20 aa, synthetic construct
  REGION 1..20: note = Synthetic
MATLLRSLALFKRNKDKPPI

SEQ ID NO: 1313 - protein, 15 aa, synthetic construct
  REGION 1..15: note = Synthetic
MDLYKSNHNNVYWLT

SEQ ID NO: 1314 - protein, 14 aa, synthetic construct
  REGION 1..14: note = Synthetic
MEDLQKALEAQSRA

SEQ ID NO: 1315 - protein, 21 aa, synthetic construct
  REGION 1..21: note = Synthetic
MEDLQKALEAQSRALRAELAA

SEQ ID NO: 1316 - protein, 15 aa, synthetic construct
  REGION 1..15: note = Synthetic
MGLKVNVSAIFMAVL

SEQ ID NO: 1317 - protein, 15 aa, synthetic construct
  REGION 1..15: note = Synthetic
MIDRPYVLLAVLFVM

SEQ ID NO: 1318 - protein, 15 aa, synthetic construct
  REGION 1..15: note = Synthetic
MILAVQGVQDYINNE

SEQ ID NO: 1319 - protein, 15 aa, synthetic construct
  REGION 1..15: note = Synthetic
MLNSQAIDNLRASLE

SEQ ID NO: 1320 - protein, 15 aa, synthetic construct
  REGION 1..15: note = Synthetic
MNALVNSTLLETRTT

SEQ ID NO: 1321 - protein, 32 aa, synthetic construct
  REGION 1..32: note = Synthetic
MNYTGNQQSRWGLGSPNCHGPDWASPVCQRHS

SEQ ID NO: 1322 - protein, 15 aa, synthetic construct
  REGION 1..15: note = Synthetic
MQSWVPLSTDDPVID

SEQ ID NO: 1323 - protein, 15 aa, synthetic construct
  REGION 1..15: note = Synthetic
MSLSLLDLYLGRGYN

SEQ ID NO: 1324 - protein, 15 aa, synthetic construct
  REGION 1..15: note = Synthetic
MSPLLQECLRGSTKS

SEQ ID NO: 1325 - protein, 15 aa, synthetic construct
  REGION 1..15: note = Synthetic
MSPQRDRINAFYKDN

SEQ ID NO: 1326 - protein, 15 aa, synthetic construct
  REGION 1..15: note = Synthetic
MYRVFEVSVIRNPGL

SEQ ID NO: 1327 - protein, 15 aa, synthetic construct
  REGION 1..15: note = Synthetic
NALYPMSPLLQECLR

SEQ ID NO: 1328 - protein, 26 aa, synthetic construct
  REGION 1..26: note = Synthetic
NCHGPDWASPVCQRHSPDCSRLVGAT

SEQ ID NO: 1329 - protein, 15 aa, synthetic construct
  REGION 1..15: note = Synthetic
NFGRSYFDPAYFRLG

SEQ ID NO: 1330 - protein, 20 aa, synthetic construct
  REGION 1..20: note = Synthetic
NFGRSYFDPAYFRLGQEMVR

SEQ ID NO: 1331 - protein, 15 aa, synthetic construct
  REGION 1..15: note = Synthetic
NGTQRACTFWAVNAY

SEQ ID NO: 1332 - protein, 15 aa, synthetic construct
  REGION 1..15: note = Synthetic
NGVTIQVGSRRYPDA

SEQ ID NO: 1333 - protein, 15 aa, synthetic construct
  REGION 1..15: note = Synthetic
NIIAEDLSLRRFMVA

SEQ ID NO: 1334 - protein, 20 aa, synthetic construct
  REGION 1..20: note = Synthetic
NIIAEDLSLRRFMVALILDI

SEQ ID NO: 1335 - protein, 15 aa, synthetic construct
  REGION 1..15: note = Synthetic
NITLLNNCTRVEIAE

SEQ ID NO: 1336 - protein, 15 aa, synthetic construct
  REGION 1..15: note = Synthetic
NLALGVINTLEWIPR

SEQ ID NO: 1337 - protein, 18 aa, synthetic construct
  REGION 1..18: note = Synthetic
NLFQVVHWSYNRPAYSPG

SEQ ID NO: 1338 - protein, 15 aa, synthetic construct
  REGION 1..15: note = Synthetic
NLVILPGQDLQYVLA

SEQ ID NO: 1339 - protein, 15 aa, synthetic construct
  REGION 1..15: note = Synthetic
NLYQQMGKPAPYMVN

SEQ ID NO: 1340 - protein, 20 aa, synthetic construct
  REGION 1..20: note = Synthetic
NLYQQMGKPAPYMVNLENSI

SEQ ID NO: 1341 - protein, 15 aa, synthetic construct
  REGION 1..15: note = Synthetic
NNCTRVEIAEYRRLL

SEQ ID NO: 1342 - protein, 10 aa, synthetic construct
  REGION 1..10: note = Synthetic
NPDREYDFRD

SEQ ID NO: 1343 - protein, 9 aa, synthetic construct
  REGION 1..9: note = Synthetic
NPDVSGPKL

SEQ ID NO: 1344 - protein, 15 aa, synthetic construct
  REGION 1..15: note = Synthetic
NPDVSGPKLTGALIG

SEQ ID NO: 1345 - protein, 20 aa, synthetic construct
  REGION 1..20: note = Synthetic
NPDVSGPKLTGALIGILSLF

SEQ ID NO: 1346 - protein, 15 aa, synthetic construct
  REGION 1..15: note = Synthetic
NPPERIKLDYDQYCA

SEQ ID NO: 1347 - protein, 15 aa, synthetic construct
  REGION 1..15: note = Synthetic
NQAKWAVPTTRTDDK

SEQ ID NO: 1348 - protein, 15 aa, synthetic construct
  REGION 1..15: note = Synthetic
NQDPDKILTYIAADH

SEQ ID NO: 1349 - protein, 15 aa, synthetic construct
  REGION 1..15: note = Synthetic
NQLSCDLIGQKLGLK

SEQ ID NO: 1350 - protein, 27 aa, synthetic construct
  REGION 1..27: note = Synthetic
NQQSRWGLGSPNCHGPDWASPVCQRHS

SEQ ID NO: 1351 - protein, 12 aa, synthetic construct
  REGION 1..12: note = Synthetic
NSTLGVKSAREF

SEQ ID NO: 1352 - protein, 15 aa, synthetic construct
  REGION 1..15: note = Synthetic
NTPHGQLEVQVPPDP

SEQ ID NO: 1353 - protein, 15 aa, synthetic construct
  REGION 1..15: note = Synthetic
NVSAIFMAVLLTLQT

SEQ ID NO: 1354 - protein, 15 aa, synthetic construct
  REGION 1..15: note = Synthetic
PAEVDGDVKLSSNLV

SEQ ID NO: 1355 - protein, 15 aa, synthetic construct
  REGION 1..15: note = Synthetic
PAFGHSDAACWGFPT

SEQ ID NO: 1356 - protein, 15 aa, synthetic construct
  REGION 1..15: note = Synthetic
PALICCCRGRCNKKG

SEQ ID NO: 1357 - protein, 13 aa, synthetic construct
  REGION 1..13: note = Synthetic
PDKILTYIAADHC

SEQ ID NO: 1358 - protein, 15 aa, synthetic construct
  REGION 1..15: note = Synthetic
PERIKLDYDQYCADV

SEQ ID NO: 1359 - protein, 8 aa, synthetic construct
  REGION 1..8: note = Synthetic
PERPRLRL

SEQ ID NO: 1360 - protein, 15 aa, synthetic construct
  REGION 1..15: note = Synthetic
PGCATQAPVPVRLAG

SEQ ID NO: 1361 - protein, 29 aa, synthetic construct
  REGION 1..29: note = Synthetic
PGCATQAPVPVRLAGVRFESKIVDGGCFA

SEQ ID NO: 1362 - protein, 8 aa, synthetic construct
  REGION 1..8: note = Synthetic
PGEVWVTP

SEQ ID NO: 1363 - protein, 15 aa, synthetic construct
  REGION 1..15: note = Synthetic
PGEVWVTPVIGSQAR

SEQ ID NO: 1364 - protein, 16 aa, synthetic construct
  REGION 1..16: note = Synthetic
PGKLDVNKSKTHISVN

SEQ ID NO: 1365 - protein, 15 aa, synthetic construct
  REGION 1..15: note = Synthetic
PGLGAPVFHMTNYLE

SEQ ID NO: 1366 - protein, 8 aa, synthetic construct
  REGION 1..8: note = Synthetic
PGPGEVWV

SEQ ID NO: 1367 - protein, 15 aa, synthetic construct
  REGION 1..15: note = Synthetic
PHKTVRVKFHTETRT

SEQ ID NO: 1368 - protein, 15 aa, synthetic construct
  REGION 1..15: note = Synthetic
PIELQVECFTWDQKL

SEQ ID NO: 1369 - protein, 10 aa, synthetic construct
  REGION 1..10: note = Synthetic
PISLERLDVG

SEQ ID NO: 1370 - protein, 15 aa, synthetic construct
  REGION 1..15: note = Synthetic
PISLERLDVGTNLGN

SEQ ID NO: 1371 - protein, 15 aa, synthetic construct
  REGION 1..15: note = Synthetic
PKALFTQQGGAYGRC

SEQ ID NO: 1372 - protein, 15 aa, synthetic construct
  REGION 1..15: note = Synthetic
PKYVATQGYLISNFD

SEQ ID NO: 1373 - protein, 13 aa, synthetic construct
  REGION 1..13: note = Synthetic
PLDIDTASESSQD

SEQ ID NO: 1374 - protein, 15 aa, synthetic construct
  REGION 1..15: note = Synthetic
PLGLKFKTVRPVALP

SEQ ID NO: 1375 - protein, 15 aa, synthetic construct
  REGION 1..15: note = Synthetic
PLITHGSGMDLYKSN

SEQ ID NO: 1376 - protein, 15 aa, synthetic construct
  REGION 1..15: note = Synthetic
PLKDNRIPSYGVLSV

SEQ ID NO: 1377 - protein, 8 aa, synthetic construct
  REGION 1..8: note = Synthetic
PLLRTAPG

SEQ ID NO: 1378 - protein, 13 aa, synthetic construct
  REGION 1..13: note = Synthetic
PLLSCKPWQESRK

SEQ ID NO: 1379 - protein, 14 aa, synthetic construct
  REGION 1..14: note = Synthetic
PPATVYRYDSRPPE

SEQ ID NO: 1380 - protein, 12 aa, synthetic construct
  REGION 1..12: note = Synthetic
PPISLERLDVGT

SEQ ID NO: 1381 - protein, 20 aa, synthetic construct
  REGION 1..20: note = Synthetic
PPPPEERQETRSQTPAPKPS

SEQ ID NO: 1382 - protein, 15 aa, synthetic construct
  REGION 1..15: note = Synthetic
PQEQITQHGSPYGRC

SEQ ID NO: 1383 - protein, 18 aa, synthetic construct
  REGION 1..18: note = Synthetic
PQEQITQHGSPYGRCANK

SEQ ID NO: 1384 - protein, 25 aa, synthetic construct
  REGION 1..25: note = Synthetic
PQPGPQPPQPPQPQPEAPAPQPPAG

SEQ ID NO: 1385 - protein, 13 aa, synthetic construct
  REGION 1..13: note = Synthetic
PRLGGKEDRRVKQ

SEQ ID NO: 1386 - protein, 8 aa, synthetic construct
  REGION 1..8: note = Synthetic
PRLRLVDA

SEQ ID NO: 1387 - protein, 15 aa, synthetic construct
  REGION 1..15: note = Synthetic
PRNVRVTGCYQCGTP

SEQ ID NO: 1388 - protein, 13 aa, synthetic construct
  REGION 1..13: note = Synthetic
PSRASDARAAHLP

SEQ ID NO: 1389 - protein, 15 aa, synthetic construct
  REGION 1..15: note = Synthetic
PTGQIHWGNLSKIGV

SEQ ID NO: 1390 - protein, 13 aa, synthetic construct
  REGION 1..13: note = Synthetic
PTGTPLDIDTASE

SEQ ID NO: 1391 - protein, 15 aa, synthetic construct
  REGION 1..15: note = Synthetic
PTLSEIKGVIVHRLE

SEQ ID NO: 1392 - protein, 15 aa, synthetic construct
  REGION 1..15: note = Synthetic
PTTIRGQFSNMSLSL

SEQ ID NO: 1393 - protein, 10 aa, synthetic construct
  REGION 1..10: note = Synthetic
PTTRTDDKLR

SEQ ID NO: 1394 - protein, 21 aa, synthetic construct
  REGION 1..21: note = Synthetic
PTTRTDDKLRMETCFQQACKG

SEQ ID NO: 1395 - protein, 15 aa, synthetic construct
  REGION 1..15: note = Synthetic
PVALPRTLAPPRNVR

SEQ ID NO: 1396 - protein, 19 aa, synthetic construct
  REGION 1..19: note = Synthetic
PVFAGANYAAWAVNVAQVI

SEQ ID NO: 1397 - protein, 8 aa, synthetic construct
  REGION 1..8: note = Synthetic
PVIGSQAR

SEQ ID NO: 1398 - protein, 15 aa, synthetic construct
  REGION 1..15: note = Synthetic
PVVEVNGVTIQVGSR

SEQ ID NO: 1399 - protein, 20 aa, synthetic construct
  REGION 1..20: note = Synthetic
PWELVVLTARPEDGWTCRGV

SEQ ID NO: 1400 - protein, 13 aa, synthetic construct
  REGION 1..13: note = Synthetic
PWQESRKNKAQTR

SEQ ID NO: 1401 - protein, 15 aa, synthetic construct
  REGION 1..15: note = Synthetic
PYMVNLENSIQNKFS

SEQ ID NO: 1402 - protein, 20 aa, synthetic construct
  REGION 1..20: note = Synthetic
PYMVNLENSIQNKFSAGSYP

SEQ ID NO: 1403 - protein, 10 aa, synthetic construct
  REGION 1..10: note = Synthetic
PYQGSGKGVS

SEQ ID NO: 1404 - protein, 15 aa, synthetic construct
  REGION 1..15: note = Synthetic
PYQVSCGGESDRASA

SEQ ID NO: 1405 - protein, 13 aa, synthetic construct
  REGION 1..13: note = Synthetic
QACKGKIQALCEN

SEQ ID NO: 1406 - protein, 15 aa, synthetic construct
  REGION 1..15: note = Synthetic
QAGQEMILAVQGVQD

SEQ ID NO: 1407 - protein, 15 aa, synthetic construct
  REGION 1..15: note = Synthetic
QALCENPECVPLKDN

SEQ ID NO: 1408 - protein, 7 aa, synthetic construct
  REGION 1..7: note = Synthetic
QALGALK

SEQ ID NO: 1409 - protein, 15 aa, synthetic construct
  REGION 1..15: note = Synthetic
QAPVPVRLAGVRFES

SEQ ID NO: 1410 - protein, 15 aa, synthetic construct
  REGION 1..15: note = Synthetic
QCGTPALVEGLAPGG

SEQ ID NO: 1411 - protein, 15 aa, synthetic construct
  REGION 1..15: note = Synthetic
QDPDKILTYIAADHC

SEQ ID NO: 1412 - protein, 15 aa, synthetic construct
  REGION 1..15: note = Synthetic
QECLRGSTKSCARTL

SEQ ID NO: 1413 - protein, 14 aa, synthetic construct
  REGION 1..14: note = Synthetic
QEQITQHGSPYGRC

SEQ ID NO: 1414 - protein, 13 aa, synthetic construct
  REGION 1..13: note = Synthetic
QESRKNKAQTRTP

SEQ ID NO: 1415 - protein, 15 aa, synthetic construct
  REGION 1..15: note = Synthetic
QGDQSENELPRLGGK

SEQ ID NO: 1416 - protein, 20 aa, synthetic construct
  REGION 1..20: note = Synthetic
QGDQSENELPRLGGKEDRRV

SEQ ID NO: 1417 - protein, 20 aa, synthetic construct
  REGION 1..20: note = Synthetic
QGESGHDIKITAENTPLPIA

SEQ ID NO: 1418 - protein, 15 aa, synthetic construct
  REGION 1..15: note = Synthetic
QGSGKGVSFQLVKLG

SEQ ID NO: 1419 - protein, 15 aa, synthetic construct
  REGION 1..15: note = Synthetic
QGVQDYINNELIPSM

SEQ ID NO: 1420 - protein, 15 aa, synthetic construct
  REGION 1..15: note = Synthetic
QLEVQVPPDPGDLVE

SEQ ID NO: 1421 - protein, 9 aa, synthetic construct
  REGION 1..9: note = Synthetic
QLPEATFMV

SEQ ID NO: 1422 - protein, 25 aa, synthetic construct
  REGION 1..25: note = Synthetic
QLPFLGHDGHHGGTLRVGQHYRNAS

SEQ ID NO: 1423 - protein, 10 aa, synthetic construct
  REGION 1..10: note = Synthetic
QLSMYRVFEV

SEQ ID NO: 1424 - protein, 6 aa, synthetic construct
  REGION 1..6: note = Synthetic
QLSNIT

SEQ ID NO: 1425 - protein, 15 aa, synthetic construct
  REGION 1..15: note = Synthetic
QNIRPVQSVASSRRH

SEQ ID NO: 1426 - protein, 15 aa, synthetic construct
  REGION 1..15: note = Synthetic
QNKFSAGSYPLLWSY

SEQ ID NO: 1427 - protein, 20 aa, synthetic construct
  REGION 1..20: note = Synthetic
QNKFSAGSYPLLWSYAMGVG

SEQ ID NO: 1428 - protein, 25 aa, synthetic construct
  REGION 1..25: note = Synthetic
QNKFSAGSYPLLWSYAMGVGVELEN

SEQ ID NO: 1429 - protein, 15 aa, synthetic construct
  REGION 1..15: note = Synthetic
QQACKGKIQALCENP

SEQ ID NO: 1430 - protein, 15 aa, synthetic construct
  REGION 1..15: note = Synthetic
QQRRVVGEFRLERKW

SEQ ID NO: 1431 - protein, 20 aa, synthetic construct
  REGION 1..20: note = Synthetic
QQRRVVGEFRLERKWLDVVR

SEQ ID NO: 1432 - protein, 18 aa, synthetic construct
  REGION 1..18: note = Synthetic
QQTRANPNPYTSRRSVAS

SEQ ID NO: 1433 - protein, 15 aa, synthetic construct
  REGION 1..15: note = Synthetic
QRHSPDCSRLVGATP

SEQ ID NO: 1434 - protein, 15 aa, synthetic construct
  REGION 1..15: note = Synthetic
QSGLTFASRGTNMED

SEQ ID NO: 1435 - protein, 20 aa, synthetic construct
  REGION 1..20: note = Synthetic
QSGLTFASRGTNMEDEADQY

SEQ ID NO: 1436 - protein, 20 aa, synthetic construct
  REGION 1..20: note = Synthetic
QSIALSSLMVAQAIPLVGEL

SEQ ID NO: 1437 - protein, 15 aa, synthetic construct
  REGION 1..15: note = Synthetic
QSRFGWFENKEISDI

SEQ ID NO: 1438 - protein, 20 aa, synthetic construct
  REGION 1..20: note = Synthetic
QSRFGWFENKEISDIEVQDP

SEQ ID NO: 1439 - protein, 7 aa, synthetic construct
  REGION 1..7: note = Synthetic
QSRGEAR

SEQ ID NO: 1440 - protein, 18 aa, synthetic construct
  REGION 1..18: note = Synthetic
QSRGEARESYRETGPSRA

SEQ ID NO: 1441 - protein, 18 aa, synthetic construct
  REGION 1..18: note = Synthetic
QTGRGGSAPRPELGPPTN

SEQ ID NO: 1442 - protein, 25 aa, synthetic construct
  REGION 1..25: note = Synthetic
QTPAPKPSRAPPQQPQPPRMQTGRG

SEQ ID NO: 1443 - protein, 15 aa, synthetic construct
  REGION 1..15: note = Synthetic
QVGSRRYPDAVYLHR

SEQ ID NO: 1444 - protein, 13 aa, synthetic construct
  REGION 1..13: note = Synthetic
QVSFLQGDQSENE

SEQ ID NO: 1445 - protein, 15 aa, synthetic construct
  REGION 1..15: note = Synthetic
QYHPTACEVEPAFGH

SEQ ID NO: 1446 - protein, 15 aa, synthetic construct
  REGION 1..15: note = Synthetic
QYVLATYDTSRVEHA

SEQ ID NO: 1447 - protein, 13 aa, synthetic construct
  REGION 1..13: note = Synthetic
RANPNPYTSRRSV

SEQ ID NO: 1448 - protein, 13 aa, synthetic construct
  REGION 1..13: note = Synthetic
RASDARAAHLPTG

SEQ ID NO: 1449 - protein, 15 aa, synthetic construct
  REGION 1..15: note = Synthetic
RASLETTNQAIEAIR

SEQ ID NO: 1450 - protein, 20 aa, synthetic construct
  REGION 1..20: note = Synthetic
RCGRLICGLSTTAQYPPTRF

SEQ ID NO: 1451 - protein, 19 aa, synthetic construct
  REGION 1..19: note = Synthetic
RDGQSVIGACASPYEGRYR

SEQ ID NO: 1452 - protein, 13 aa, synthetic construct
  REGION 1..13: note = Synthetic
RESYRETGPSRAS

SEQ ID NO: 1453 - protein, 13 aa, synthetic construct
  REGION 1..13: note = Synthetic
RETGPSRASDARA

SEQ ID NO: 1454 - protein, 14 aa, synthetic construct
  REGION 1..14: note = Synthetic
RFAKYQQQGRLEAR

SEQ ID NO: 1455 - protein, 24 aa, synthetic construct
  REGION 1..24: note = Synthetic
RFGAPQAFLAGLLLATVAVGTARA

SEQ ID NO: 1456 - protein, 15 aa, synthetic construct
  REGION 1..15: note = Synthetic
RFMVALILDIKRTPG

SEQ ID NO: 1457 - protein, 20 aa, synthetic construct
  REGION 1..20: note = Synthetic
RFMVALILDIKRTPGNKPRI

SEQ ID NO: 1458 - protein, 13 aa, synthetic construct
  REGION 1..13: note = Synthetic
RGEARESYRETGP

SEQ ID NO: 1459 - protein, 9 aa, synthetic construct
  REGION 1..9: note = Synthetic
RGTTPPAYG

SEQ ID NO: 1460 - protein, 9 aa, synthetic construct
  REGION 1..9: note = Synthetic
RIETRSARH

SEQ ID NO: 1461 - protein, 11 aa, synthetic construct
  REGION 1..11: note = Synthetic
RILAGALATYQ

SEQ ID NO: 1462 - protein, 11 aa, synthetic construct
  REGION 1..11: note = Synthetic
RIPPENIRRVT

SEQ ID NO: 1463 - protein, 7 aa, synthetic construct
  REGION 1..7: note = Synthetic
RISNLND

SEQ ID NO: 1464 - protein, 7 aa, synthetic construct
  REGION 1..7: note = Synthetic
RLANLNG

SEQ ID NO: 1465 - protein, 15 aa, synthetic construct
  REGION 1..15: note = Synthetic
RLDVGTNLGNAIAKL

SEQ ID NO: 1466 - protein, 9 aa, synthetic construct
  REGION 1..9: note = Synthetic
RLERKWLDV

SEQ ID NO: 1467 - protein, 15 aa, synthetic construct
  REGION 1..15: note = Synthetic
RLGGKEDRRVKQSRG

SEQ ID NO: 1468 - protein, 20 aa, synthetic construct
  REGION 1..20: note = Synthetic
RLGGKEDRRVKQSRGEARES

SEQ ID NO: 1469 - protein, 9 aa, synthetic construct
  REGION 1..9: note = Synthetic
RLLDRLVRL

SEQ ID NO: 1470 - protein, 8 aa, synthetic construct
  REGION 1..8: note = Synthetic
RLRLVDAD

SEQ ID NO: 1471 - protein, 13 aa, synthetic construct
  REGION 1..13: note = Synthetic
RLRLVDADDPLLR

SEQ ID NO: 1472 - protein, 31 aa, synthetic construct
  REGION 1..31: note = Synthetic
RLRLVDADDPLLRTAPGPGEVWVTPVIGSQA

SEQ ID NO: 1473 - protein, 32 aa, synthetic construct
  REGION 1..32: note = Synthetic
RLRLVQDADDPLLRIAPGPGEVWVTPVIGSQA

SEQ ID NO: 1474 - protein, 10 aa, synthetic construct
  REGION 1..10: note = Synthetic
RLSDNGYYTV

SEQ ID NO: 1475 - protein, 8 aa, synthetic construct
  REGION 1..8: note = Synthetic
RLVDADDP

SEQ ID NO: 1476 - protein, 15 aa, synthetic construct
  REGION 1..15: note = Synthetic
RLVDADDPLLRTAPG

SEQ ID NO: 1477 - protein, 8 aa, synthetic construct
  REGION 1..8: note = Synthetic
RLVGATPE

SEQ ID NO: 1478 - protein, 27 aa, synthetic construct
  REGION 1..27: note = Synthetic
RMQTGRGGSAPRPELGPPTNPFQAAVA

SEQ ID NO: 1479 - protein, 9 aa, synthetic construct
  REGION 1..9: note = Synthetic
RMSKGVFKV

SEQ ID NO: 1480 - protein, 15 aa, synthetic construct
  REGION 1..15: note = Synthetic
RNPGLGAPVFHMTNY

SEQ ID NO: 1481 - protein, 8 aa, synthetic construct
  REGION 1..8: note = Synthetic
RPRLRLVD

SEQ ID NO: 1482 - protein, 19 aa, synthetic construct
  REGION 1..19: note = Synthetic
RQAESSEAMAAWSERAGEA

SEQ ID NO: 1483 - protein, 15 aa, synthetic construct
  REGION 1..15: note = Synthetic
RQTWAEWAAAHWWQL

SEQ ID NO: 1484 - protein, 13 aa, synthetic construct
  REGION 1..13: note = Synthetic
RRVKQSRGEARES

SEQ ID NO: 1485 - protein, 9 aa, synthetic construct
  REGION 1..9: note = Synthetic
RRYPDAVYL

SEQ ID NO: 1486 - protein, 15 aa, synthetic construct
  REGION 1..15: note = Synthetic
RRYPDAVYLHRIDLG

SEQ ID NO: 1487 - protein, 15 aa, synthetic construct
  REGION 1..15: note = Synthetic
RSAGKVSSTLASELG

SEQ ID NO: 1488 - protein, 20 aa, synthetic construct
  REGION 1..20: note = Synthetic
RSAGKVSSTLASELGITAED

SEQ ID NO: 1489 - protein, 8 aa, synthetic construct
  REGION 1..8: note = Synthetic
RSELSQLS

SEQ ID NO: 1490 - protein, 15 aa, synthetic construct
  REGION 1..15: note = Synthetic
RSELSQLSMYRVFEV

SEQ ID NO: 1491 - protein, 24 aa, synthetic construct
  REGION 1..24: note = Synthetic
RSQTPAPKPSRAPPQQPQPPRMQT

SEQ ID NO: 1492 - protein, 8 aa, synthetic construct
  REGION 1..8: note = Synthetic
RTAPGPGE

SEQ ID NO: 1493 - protein, 15 aa, synthetic construct
  REGION 1..15: note = Synthetic
RTAPGPGEVWVTPVI

SEQ ID NO: 1494 - protein, 15 aa, synthetic construct
  REGION 1..15: note = Synthetic
RTDDKLRMETCFQQA

SEQ ID NO: 1495 - protein, 15 aa, synthetic construct
  REGION 1..15: note = Synthetic
RTLAPPRNVRVTGCY

SEQ ID NO: 1496 - protein, 15 aa, synthetic construct
  REGION 1..15: note = Synthetic
RTVLEPIRDALNAMT

SEQ ID NO: 1497 - protein, 15 aa, synthetic construct
  REGION 1..15: note = Synthetic
RVEHAVVYYVYSPSR

SEQ ID NO: 1498 - protein, 15 aa, synthetic construct
  REGION 1..15: note = Synthetic
RVFEVGVIRNPGLGA

SEQ ID NO: 1499 - protein, 19 aa, synthetic construct
  REGION 1..19: note = Synthetic
RVHVSKEEQYYDYEDATFE

SEQ ID NO: 1500 - protein, 8 aa, synthetic construct
  REGION 1..8: note = Synthetic
RVIDPAAQ

SEQ ID NO: 1501 - protein, 15 aa, synthetic construct
  REGION 1..15: note = Synthetic
RVKFHTETRTVWQLS

SEQ ID NO: 1502 - protein, 11 aa, synthetic construct
  REGION 1..11: note = Synthetic
RVYHNGITGET

SEQ ID NO: 1503 - protein, 11 aa, synthetic construct
  REGION 1..11: note = Synthetic
RYDSRPPEDVF

SEQ ID NO: 1504 - protein, 15 aa, synthetic construct
  REGION 1..15: note = Synthetic
RYPDAVYLHRIDLGP

SEQ ID NO: 1505 - protein, 15 aa, synthetic construct
  REGION 1..15: note = Synthetic
SAEISIQALSYALGG

SEQ ID NO: 1506 - protein, 15 aa, synthetic construct
  REGION 1..15: note = Synthetic
SAEPLLSCKPWQESR

SEQ ID NO: 1507 - protein, 20 aa, synthetic construct
  REGION 1..20: note = Synthetic
SAEPLLSCKPWQESRKNKAQ

SEQ ID NO: 1508 - protein, 14 aa, synthetic construct
  REGION 1..14: note = Synthetic
SAGKVSSTLASELG

SEQ ID NO: 1509 - protein, 24 aa, synthetic construct
  REGION 1..24: note = Synthetic
SAGKVSSTLASELGITAEDARLVS

SEQ ID NO: 1510 - protein, 10 aa, synthetic construct
  REGION 1..10: note = Synthetic
SCTVTREDGT

SEQ ID NO: 1511 - protein, 15 aa, synthetic construct
  REGION 1..15: note = Synthetic
SDAACWGFPTDTVMS

SEQ ID NO: 1512 - protein, 13 aa, synthetic construct
  REGION 1..13: note = Synthetic
SDARAAHLPTGTP

SEQ ID NO: 1513 - protein, 23 aa, synthetic construct
  REGION 1..23: note = Synthetic
SDWHQGTHVCHTKHMDFWCVEHD

SEQ ID NO: 1514 - protein, 15 aa, synthetic construct
  REGION 1..15: note = Synthetic
SELRRWIKYTQQRRV

SEQ ID NO: 1515 - protein, 20 aa, synthetic construct
  REGION 1..20: note = Synthetic
SELRRWIKYTQQRRVVGEFR

SEQ ID NO: 1516 - protein, 6 aa, synthetic construct
  REGION 1..6: note = Synthetic
SELSQL

SEQ ID NO: 1517 - protein, 7 aa, synthetic construct
  REGION 1..7: note = Synthetic
SELSQLS

SEQ ID NO: 1518 - protein, 20 aa, synthetic construct
  REGION 1..20: note = Synthetic
SEYLAHRRIPPENIRRVTRV

SEQ ID NO: 1519 - protein, 13 aa, synthetic construct
  REGION 1..13: note = Synthetic
SFLQGDQSENELP

SEQ ID NO: 1520 - protein, 15 aa, synthetic construct
  REGION 1..15: note = Synthetic
SGKGVSFQLVKLGVW

SEQ ID NO: 1521 - protein, 15 aa, synthetic construct
  REGION 1..15: note = Synthetic
SHRGVIADNQAKWAV

SEQ ID NO: 1522 - protein, 15 aa, synthetic construct
  REGION 1..15: note = Synthetic
SIEHQVKDVLTPLFK

SEQ ID NO: 1523 - protein, 15 aa, synthetic construct
  REGION 1..15: note = Synthetic
SKIGVVGIGSASYKV

SEQ ID NO: 1524 - protein, 15 aa, synthetic construct
  REGION 1..15: note = Synthetic
SKRSELSQLSMYRVF

SEQ ID NO: 1525 - protein, 21 aa, synthetic construct
  REGION 1..21: note = Synthetic
SLFVESPGQLIQRITDDPDVS

SEQ ID NO: 1526 - protein, 15 aa, synthetic construct
  REGION 1..15: note = Synthetic
SLSTNLDVTNSIEHQ

SEQ ID NO: 1527 - protein, 25 aa, synthetic construct
  REGION 1..25: note = Synthetic
SLSTNLDVTNSIEHQVKDVLTPLFK

SEQ ID NO: 1528 - protein, 10 aa, synthetic construct
  REGION 1..10: note = Synthetic
SLWGSGLLML

SEQ ID NO: 1529 - protein, 15 aa, synthetic construct
  REGION 1..15: note = Synthetic
SMKGLSSTSIVYILI

SEQ ID NO: 1530 - protein, 10 aa, synthetic construct
  REGION 1..10: note = Synthetic
SMYRVFEVGV

SEQ ID NO: 1531 - protein, 15 aa, synthetic construct
  REGION 1..15: note = Synthetic
SNDLSNCMVALGELK

SEQ ID NO: 1532 - protein, 8 aa, synthetic construct
  REGION 1..8: note = Synthetic
SPGQLIQR

SEQ ID NO: 1533 - protein, 13 aa, synthetic construct
  REGION 1..13: note = Synthetic
SQDPQDSRRSAEP

SEQ ID NO: 1534 - protein, 15 aa, synthetic construct
  REGION 1..15: note = Synthetic
SRIVINREHLMIDRP

SEQ ID NO: 1535 - protein, 13 aa, synthetic construct
  REGION 1..13: note = Synthetic
SRKNKAQTRTPLQ

SEQ ID NO: 1536 - protein, 8 aa, synthetic construct
  REGION 1..8: note = Synthetic
SRLVGATP

SEQ ID NO: 1537 - protein, 24 aa, synthetic construct
  REGION 1..24: note = Synthetic
SRLVGATPERPRLRLVDADDPLLR

SEQ ID NO: 1538 - protein, 15 aa, synthetic construct
  REGION 1..15: note = Synthetic
SRPGLKPDLTGTSKS

SEQ ID NO: 1539 - protein, 15 aa, synthetic construct
  REGION 1..15: note = Synthetic
SRRSVASIVGTLVRM

SEQ ID NO: 1540 - protein, 15 aa, synthetic construct
  REGION 1..15: note = Synthetic
SRWGLGSPNCHGPDW

SEQ ID NO: 1541 - protein, 5 aa, synthetic construct
  REGION 1..5: note = Synthetic
SSATK

SEQ ID NO: 1542 - protein, 15 aa, synthetic construct
  REGION 1..15: note = Synthetic
SSGGYAQLASYFNPG

SEQ ID NO: 1543 - protein, 7 aa, synthetic construct
  REGION 1..7: note = Synthetic
SSLGNGV

SEQ ID NO: 1544 - protein, 15 aa, synthetic construct
  REGION 1..15: note = Synthetic
SSNLVILPGQDLQYV

SEQ ID NO: 1545 - protein, 15 aa, synthetic construct
  REGION 1..15: note = Synthetic
SSQDPQDSRRSAEPL

SEQ ID NO: 1546 - protein, 20 aa, synthetic construct
  REGION 1..20: note = Synthetic
SSQDPQDSRRSAEPLLSCKP

SEQ ID NO: 1547 - protein, 15 aa, synthetic construct
  REGION 1..15: note = Synthetic
SSRRHKRFAGVVLAG

SEQ ID NO: 1548 - protein, 15 aa, synthetic construct
  REGION 1..15: note = Synthetic
SSTSIVYILIAVCLG

SEQ ID NO: 1549 - protein, 7 aa, synthetic construct
  REGION 1..7: note = Synthetic
STPGIVI

SEQ ID NO: 1550 - protein, 23 aa, synthetic construct
  REGION 1..23: note = Synthetic
STPGIVIPPQEQITQHGSPYGRC

SEQ ID NO: 1551 - protein, 12 aa, synthetic construct
  REGION 1..12: note = Synthetic
STSSSRRYTEVY

SEQ ID NO: 1552 - protein, 15 aa, synthetic construct
  REGION 1..15: note = Synthetic
SYFIVLSIAYPTLSE

SEQ ID NO: 1553 - protein, 13 aa, synthetic construct
  REGION 1..13: note = Synthetic
SYRETGPSRASDA

SEQ ID NO: 1554 - protein, 4 aa, synthetic construct
  REGION 1..4: note = Synthetic
SYVK

SEQ ID NO: 1555 - protein, 15 aa, synthetic construct
  REGION 1..15: note = Synthetic
SYVQHPHKTVRVKFH

SEQ ID NO: 1556 - protein, 8 aa, synthetic construct
  REGION 1..8: note = Synthetic
TAPGPGEV

SEQ ID NO: 1557 - protein, 14 aa, synthetic construct
  REGION 1..14: note = Synthetic
TATRLLSSTNSRLC

SEQ ID NO: 1558 - protein, 15 aa, synthetic construct
  REGION 1..15: note = Synthetic
TDDPVIDRLYLSSHR

SEQ ID NO: 1559 - protein, 15 aa, synthetic construct
  REGION 1..15: note = Synthetic
TEILSLFGPSLRDPI

SEQ ID NO: 1560 - protein, 15 aa, synthetic construct
  REGION 1..15: note = Synthetic
TETRTVWQLSVAGVS

SEQ ID NO: 1561 - protein, 14 aa, synthetic construct
  REGION 1..14: note = Synthetic
TEVYLEHRMQEAVE

SEQ ID NO: 1562 - protein, 15 aa, synthetic construct
  REGION 1..15: note = Synthetic
TFMPEGTVCSQNALY

SEQ ID NO: 1563 - protein, 15 aa, synthetic construct
  REGION 1..15: note = Synthetic
TGACICEIPTDVSCE

SEQ ID NO: 1564 - protein, 7 aa, synthetic construct
  REGION 1..7: note = Synthetic
TGDLRAY

SEQ ID NO: 1565 - protein, 15 aa, synthetic construct
  REGION 1..15: note = Synthetic
TGMQSWVPLSTDDPV

SEQ ID NO: 1566 - protein, 15 aa, synthetic construct
  REGION 1..15: note = Synthetic
TGNQQSRWGLGSPNC

SEQ ID NO: 1567 - protein, 13 aa, synthetic construct
  REGION 1..13: note = Synthetic
TGPSRASDARAAH

SEQ ID NO: 1568 - protein, 15 aa, synthetic construct
  REGION 1..15: note = Synthetic
TGTIINQDPDKILTY

SEQ ID NO: 1569 - protein, 15 aa, synthetic construct
  REGION 1..15: note = Synthetic
TGVVYGTHTTAVSET

SEQ ID NO: 1570 - protein, 15 aa, synthetic construct
  REGION 1..15: note = Synthetic
TIRGQFSNMSLSLLD

SEQ ID NO: 1571 - protein, 15 aa, synthetic construct
  REGION 1..15: note = Synthetic
TLGATCALPLAGLLA

SEQ ID NO: 1572 - protein, 9 aa, synthetic construct
  REGION 1..9: note = Synthetic
TLLNNCTRV

SEQ ID NO: 1573 - protein, 12 aa, synthetic construct
  REGION 1..12: note = Synthetic
TLNVPPPPDPGR

SEQ ID NO: 1574 - protein, 22 aa, synthetic construct
  REGION 1..22: note = Synthetic
TLNVPPPPDPGRASTSGTPIKK

SEQ ID NO: 1575 - protein, 15 aa, synthetic construct
  REGION 1..15: note = Synthetic
TMTSQGMYGGTYPVE

SEQ ID NO: 1576 - protein, 15 aa, synthetic construct
  REGION 1..15: note = Synthetic
TNLGNAIAKLEDAKE

SEQ ID NO: 1577 - protein, 15 aa, synthetic construct
  REGION 1..15: note = Synthetic
TNMEDEADQYFSHDD

SEQ ID NO: 1578 - protein, 20 aa, synthetic construct
  REGION 1..20: note = Synthetic
TNMEDEADQYFSHDDPISSD

SEQ ID NO: 1579 - protein, 15 aa, synthetic construct
  REGION 1..15: note = Synthetic
TNPFQAAVARGLRPP

SEQ ID NO: 1580 - protein, 15 aa, synthetic construct
  REGION 1..15: note = Synthetic
TNSIEHQVKDVLTPL

SEQ ID NO: 1581 - protein, 15 aa, synthetic construct
  REGION 1..15: note = Synthetic
TNYLEQPVSNDLSNC

SEQ ID NO: 1582 - protein, 27 aa, synthetic construct
  REGION 1..27: note = Synthetic
TNYLEQPVSNDLSNCMVALGELKLAAL

SEQ ID NO: 1583 - protein, 8 aa, synthetic construct
  REGION 1..8: note = Synthetic
TPERPRLR

SEQ ID NO: 1584 - protein, 20 aa, synthetic construct
  REGION 1..20: note = Synthetic
TPERPRLRLVDADDPLLRTA

SEQ ID NO: 1585 - protein, 9 aa, synthetic construct
  REGION 1..9: note = Synthetic
TPGNKPRIA

SEQ ID NO: 1586 - protein, 15 aa, synthetic construct
  REGION 1..15: note = Synthetic
TPLDIDTASESSQDP

SEQ ID NO: 1587 - protein, 20 aa, synthetic construct
  REGION 1..20: note = Synthetic
TPLDIDTASESSQDPQDSRR

SEQ ID NO: 1588 - protein, 15 aa, synthetic construct
  REGION 1..15: note = Synthetic
TPLFKIIGDEVGLRT

SEQ ID NO: 1589 - protein, 7 aa, synthetic construct
  REGION 1..7: note = Synthetic
TPLQCTM

SEQ ID NO: 1590 - protein, 8 aa, synthetic construct
  REGION 1..8: note = Synthetic
TPVIGSQA

SEQ ID NO: 1591 - protein, 10 aa, synthetic construct
  REGION 1..10: note = Synthetic
TPVIGSQARK

SEQ ID NO: 1592 - protein, 15 aa, synthetic construct
  REGION 1..15: note = Synthetic
TQGYLISNFDESSCT

SEQ ID NO: 1593 - protein, 24 aa, synthetic construct
  REGION 1..24: note = Synthetic
TRANPNPYTSRRSVASIVGTLVRM

SEQ ID NO: 1594 - protein, 13 aa, synthetic construct
  REGION 1..13: note = Synthetic
TRFGCAMRWGLPP

SEQ ID NO: 1595 - protein, 16 aa, synthetic construct
  REGION 1..16: note = Synthetic
TRNTGQPATDHYYSNV

SEQ ID NO: 1596 - protein, 13 aa, synthetic construct
  REGION 1..13: note = Synthetic
TRTPLQCTMTEIF

SEQ ID NO: 1597 - protein, 12 aa, synthetic construct
  REGION 1..12: note = Synthetic
TRWHRLLRMPVR

SEQ ID NO: 1598 - protein, 15 aa, synthetic construct
  REGION 1..15: note = Synthetic
TSGSGGAIRGIKHII

SEQ ID NO: 1599 - protein, 20 aa, synthetic construct
  REGION 1..20: note = Synthetic
TSGSGGAIRGIKHIIIVPIP

SEQ ID NO: 1600 - protein, 15 aa, synthetic construct
  REGION 1..15: note = Synthetic
TSQGMYGGTYLVEKP

SEQ ID NO: 1601 - protein, 15 aa, synthetic construct
  REGION 1..15: note = Synthetic
TSRVEHAVVYYVYSP

SEQ ID NO: 1602 - protein, 12 aa, synthetic construct
  REGION 1..12: note = Synthetic
TSSSRRYTEVYL

SEQ ID NO: 1603 - protein, 5 aa, synthetic construct
  REGION 1..5: note = Synthetic
TSYVG

SEQ ID NO: 1604 - protein, 15 aa, synthetic construct
  REGION 1..15: note = Synthetic
TTEDKISRAVGPRQA

SEQ ID NO: 1605 - protein, 20 aa, synthetic construct
  REGION 1..20: note = Synthetic
TTEDKISRAVGPRQAQVSFL

SEQ ID NO: 1606 - protein, 13 aa, synthetic construct
  REGION 1..13: note = Synthetic
TTERIETRSARHP

SEQ ID NO: 1607 - protein, 15 aa, synthetic construct
  REGION 1..15: note = Synthetic
TTNQAIEAIRQAGQE

SEQ ID NO: 1608 - protein, 15 aa, synthetic construct
  REGION 1..15: note = Synthetic
TTSDPWHPPGPLGLK

SEQ ID NO: 1609 - protein, 15 aa, synthetic construct
  REGION 1..15: note = Synthetic
TVCSQNALYPMSPLL

SEQ ID NO: 1610 - protein, 15 aa, synthetic construct
  REGION 1..15: note = Synthetic
TVNGEDVGAVPPGKF

SEQ ID NO: 1611 - protein, 15 aa, synthetic construct
  REGION 1..15: note = Synthetic
TYPVEKPNLSSKRSE

SEQ ID NO: 1612 - protein, 15 aa, synthetic construct
  REGION 1..15: note = Synthetic
VAGVSCNVTTEHPFC

SEQ ID NO: 1613 - protein, 23 aa, synthetic construct
  REGION 1..23: note = Synthetic
VAPGIVIPPKALFTQQGGAYGRC

SEQ ID NO: 1614 - protein, 25 aa, synthetic construct
  REGION 1..25: note = Synthetic
VCHTKHMDFWCVEHDRPPPATPTPL

SEQ ID NO: 1615 - protein, 19 aa, synthetic construct
  REGION 1..19: note = Synthetic
VCQRHSPDCSRLVGATPER

SEQ ID NO: 1616 - protein, 8 aa, synthetic construct
  REGION 1..8: note = Synthetic
VDADDPLL

SEQ ID NO: 1617 - protein, 20 aa, synthetic construct
  REGION 1..20: note = Synthetic
VDADDPLLRTAPGPGEVWVT

SEQ ID NO: 1618 - protein, 20 aa, synthetic construct
  REGION 1..20: note = Synthetic
VDIGFAAYNFVESIINLFQV

SEQ ID NO: 1619 - protein, 15 aa, synthetic construct
  REGION 1..15: note = Synthetic
VEIAEYRRLLRTVLE

SEQ ID NO: 1620 - protein, 15 aa, synthetic construct
  REGION 1..15: note = Synthetic
VELENSMGGLNFGRS

SEQ ID NO: 1621 - protein, 20 aa, synthetic construct
  REGION 1..20: note = Synthetic
VELENSMGGLNFGRSYFDPA

SEQ ID NO: 1622 - protein, 15 aa, synthetic construct
  REGION 1..15: note = Synthetic
VELKIKIASGFGPLI

SEQ ID NO: 1623 - protein, 14 aa, synthetic construct
  REGION 1..14: note = Synthetic
VEMDEWIHAHTTSD

SEQ ID NO: 1624 - protein, 15 aa, synthetic construct
  REGION 1..15: note = Synthetic
VEMPEWIHAHTTSDP

SEQ ID NO: 1625 - protein, 9 aa, synthetic construct
  REGION 1..9: note = Synthetic
VERRLVKVL

SEQ ID NO: 1626 - protein, 8 aa, synthetic construct
  REGION 1..8: note = Synthetic
VESPGQLI

SEQ ID NO: 1627 - protein, 15 aa, synthetic construct
  REGION 1..15: note = Synthetic
VESPGQLIQRITDDP

SEQ ID NO: 1628 - protein, 20 aa, synthetic construct
  REGION 1..20: note = Synthetic
VESPGQLIQRITDDPDVSIR

SEQ ID NO: 1629 - protein, 15 aa, synthetic construct
  REGION 1..15: note = Synthetic
VFALASYVQHPHKTV

SEQ ID NO: 1630 - protein, 8 aa, synthetic construct
  REGION 1..8: note = Synthetic
VGATPERP

SEQ ID NO: 1631 - protein, 10 aa, synthetic construct
  REGION 1..10: note = Synthetic
VGATPERPRL

SEQ ID NO: 1632 - protein, 15 aa, synthetic construct
  REGION 1..15: note = Synthetic
VGATPERPRLRLVDA

SEQ ID NO: 1633 - protein, 15 aa, synthetic construct
  REGION 1..15: note = Synthetic
VGIGSASYKVMTRSS

SEQ ID NO: 1634 - protein, 15 aa, synthetic construct
  REGION 1..15: note = Synthetic
VGLRTPQRFTDLVKF

SEQ ID NO: 1635 - protein, 20 aa, synthetic construct
  REGION 1..20: note = Synthetic
VHHNTEEIVAQSIALSSLMV

SEQ ID NO: 1636 - protein, 15 aa, synthetic construct
  REGION 1..15: note = Synthetic
VHRLEGVSYNIGSQE

SEQ ID NO: 1637 - protein, 8 aa, synthetic construct
  REGION 1..8: note = Synthetic
VIGSQARK

SEQ ID NO: 1638 - protein, 6 aa, synthetic construct
  REGION 1..6: note = Synthetic
VITGSI

SEQ ID NO: 1639 - protein, 6 aa, synthetic construct
  REGION 1..6: note = Synthetic
VITGTI

SEQ ID NO: 1640 - protein, 8 aa, synthetic construct
  REGION 1..8: note = Synthetic
VKQSRGEA

SEQ ID NO: 1641 - protein, 10 aa, synthetic construct
  REGION 1..10: note = Synthetic
VLFVMFLSLI

SEQ ID NO: 1642 - protein, 15 aa, synthetic construct
  REGION 1..15: note = Synthetic
VLFVMFLSLIGLLAI

SEQ ID NO: 1643 - protein, 15 aa, synthetic construct
  REGION 1..15: note = Synthetic
VLTPLFKIIGDEVGL

SEQ ID NO: 1644 - protein, 15 aa, synthetic construct
  REGION 1..15: note = Synthetic
VMTRSSHQSLVIKLM

SEQ ID NO: 1645 - protein, 15 aa, synthetic construct
  REGION 1..15: note = Synthetic
VPAAPCARIWNGTQR

SEQ ID NO: 1646 - protein, 15 aa, synthetic construct
  REGION 1..15: note = Synthetic
VPPDPGDLVEYIMNY

SEQ ID NO: 1647 - protein, 15 aa, synthetic construct
  REGION 1..15: note = Synthetic
VQSVASSRRHKRFAG

SEQ ID NO: 1648 - protein, 17 aa, synthetic construct
  REGION 1..17: note = Synthetic
VQTGGTSRTVTMRYLAS

SEQ ID NO: 1649 - protein, 5 aa, synthetic construct
  REGION 1..5: note = Synthetic
VQVRI

SEQ ID NO: 1650 - protein, 11 aa, synthetic construct
  REGION 1..11: note = Synthetic
VRAYNQPAGDV

SEQ ID NO: 1651 - protein, 15 aa, synthetic construct
  REGION 1..15: note = Synthetic
VRFESKIVDGGCFAP

SEQ ID NO: 1652 - protein, 15 aa, synthetic construct
  REGION 1..15: note = Synthetic
VRLAGVRFESKIVDG

SEQ ID NO: 1653 - protein, 15 aa, synthetic construct
  REGION 1..15: note = Synthetic
VSGSFGNRFILSQGN

SEQ ID NO: 1654 - protein, 14 aa, synthetic construct
  REGION 1..14: note = Synthetic
VSKEEQYYDYEDAT

SEQ ID NO: 1655 - protein, 15 aa, synthetic construct
  REGION 1..15: note = Synthetic
VSKGNCSGPTTIRGQ

SEQ ID NO: 1656 - protein, 15 aa, synthetic construct
  REGION 1..15: note = Synthetic
VTAALLNTPPPYQVS

SEQ ID NO: 1657 - protein, 15 aa, synthetic construct
  REGION 1..15: note = Synthetic
VTGCYQCGTPALVEG

SEQ ID NO: 1658 - protein, 8 aa, synthetic construct
  REGION 1..8: note = Synthetic
VTPVIGSQ

SEQ ID NO: 1659 - protein, 22 aa, synthetic construct
  REGION 1..22: note = Synthetic
VTTEHPFCNTPHGQLEVQVPPD

SEQ ID NO: 1660 - protein, 15 aa, synthetic construct
  REGION 1..15: note = Synthetic
VVLAGAALGVATAAQ

SEQ ID NO: 1661 - protein, 15 aa, synthetic construct
  REGION 1..15: note = Synthetic
VWQLSVAGVSCNVTT

SEQ ID NO: 1662 - protein, 8 aa, synthetic construct
  REGION 1..8: note = Synthetic
VWVTPVIG

SEQ ID NO: 1663 - protein, 12 aa, synthetic construct
  REGION 1..12: note = Synthetic
VWVTPVIGSQAR

SEQ ID NO: 1664 - protein, 15 aa, synthetic construct
  REGION 1..15: note = Synthetic
VYILIAVCLGGLIGI

SEQ ID NO: 1665 - protein, 15 aa, synthetic construct
  REGION 1..15: note = Synthetic
VYLHRIDLGPPISLE

SEQ ID NO: 1666 - protein, 8 aa, synthetic construct
  REGION 1..8: note = Synthetic
VYRYDSRP

SEQ ID NO: 1667 - protein, 12 aa, synthetic construct
  REGION 1..12: note = Synthetic
VYRYDSRPPEDV

SEQ ID NO: 1668 - protein, 15 aa, synthetic construct
  REGION 1..15: note = Synthetic
VYWLTIPPMKNLALG

SEQ ID NO: 1669 - protein, 15 aa, synthetic construct
  REGION 1..15: note = Synthetic
WDLEATGACICEIPT

SEQ ID NO: 1670 - protein, 15 aa, synthetic construct
  REGION 1..15: note = Synthetic
WDQKLWCRHFCVLAD

SEQ ID NO: 1671 - protein, 15 aa, synthetic construct
  REGION 1..15: note = Synthetic
WGFPTDTVMSVFALA

SEQ ID NO: 1672 - protein, 15 aa, synthetic construct
  REGION 1..15: note = Synthetic
WHPPGPLGLKFKTVR

SEQ ID NO: 1673 - protein, 15 aa, synthetic construct
  REGION 1..15: note = Synthetic
WIHAHTTSDPWHPPG

SEQ ID NO: 1674 - protein, 15 aa, synthetic construct
  REGION 1..15: note = Synthetic
WLTIPPMKNLALGVI

SEQ ID NO: 1675 - protein, 20 aa, synthetic construct
  REGION 1..20: note = Synthetic
WQESRKNKAQTRTPLQCTMT

SEQ ID NO: 1676 - protein, 13 aa, synthetic construct
  REGION 1..13: note = Synthetic
WVCIFMVCRRACR

SEQ ID NO: 1677 - protein, 8 aa, synthetic construct
  REGION 1..8: note = Synthetic
WVTPVIGS

SEQ ID NO: 1678 - protein, 15 aa, synthetic construct
  REGION 1..15: note = Synthetic
WYTTVPKYVATQGYL

SEQ ID NO: 1679 - protein, 15 aa, synthetic construct
  REGION 1..15: note = Synthetic
YALGGDINKVLEKLG

SEQ ID NO: 1680 - protein, 10 aa, synthetic construct
  REGION 1..10: note = Synthetic
YAMGVGVELE

SEQ ID NO: 1681 - protein, 11 aa, synthetic construct
  REGION 1..11: note = Synthetic
YAMGVGVELEN

SEQ ID NO: 1682 - protein, 15 aa, synthetic construct
  REGION 1..15: note = Synthetic
YCADVAAEELMNALV

SEQ ID NO: 1683 - protein, 15 aa, synthetic construct
  REGION 1..15: note = Synthetic
YDFRDLTWCINPPER

SEQ ID NO: 1684 - protein, 7 aa, synthetic construct
  REGION 1..7: note = Synthetic
YFEPGPT

SEQ ID NO: 1685 - protein, 15 aa, synthetic construct
  REGION 1..15: note = Synthetic
YFNPGGSYYKQYHPT

SEQ ID NO: 1686 - protein, 15 aa, synthetic construct
  REGION 1..15: note = Synthetic
YFRLGQEMVRRSAGK

SEQ ID NO: 1687 - protein, 20 aa, synthetic construct
  REGION 1..20: note = Synthetic
YFRLGQEMVRRSAGKVSSTL

SEQ ID NO: 1688 - protein, 15 aa, synthetic construct
  REGION 1..15: note = Synthetic
YFYPFRLPIKGVPIE

SEQ ID NO: 1689 - protein, 15 aa, synthetic construct
  REGION 1..15: note = Synthetic
YGDNAGRILAGALAT

SEQ ID NO: 1690 - protein, 15 aa, synthetic construct
  REGION 1..15: note = Synthetic
YGHATVEMPEWIHAH

SEQ ID NO: 1691 - protein, 15 aa, synthetic construct
  REGION 1..15: note = Synthetic
YIMNYTGNQQSRWGL

SEQ ID NO: 1692 - protein, 15 aa, synthetic construct
  REGION 1..15: note = Synthetic
YINNELIPSMNQLSC

SEQ ID NO: 1693 - protein, 15 aa, synthetic construct
  REGION 1..15: note = Synthetic
YLCTAPGCATQAPVP

SEQ ID NO: 1694 - protein, 15 aa, synthetic construct
  REGION 1..15: note = Synthetic
YLFTVPIKEAGEDCH

SEQ ID NO: 1695 - protein, 9 aa, synthetic construct
  REGION 1..9: note = Synthetic
YLHDPEFNL

SEQ ID NO: 1696 - protein, 9 aa, synthetic construct
  REGION 1..9: note = Synthetic
YLNMSRLFV

SEQ ID NO: 1697 - protein, 9 aa, synthetic construct
  REGION 1..9: note = Synthetic
YPALGLHEF

SEQ ID NO: 1698 - protein, 10 aa, synthetic construct
  REGION 1..10: note = Synthetic
YPALGLHEFA

SEQ ID NO: 1699 - protein, 15 aa, synthetic construct
  REGION 1..15: note = Synthetic
YPALGLHEFAGELST

SEQ ID NO: 1700 - protein, 20 aa, synthetic construct
  REGION 1..20: note = Synthetic
YPALGLHEFAGELSTLESLM

SEQ ID NO: 1701 - protein, 15 aa, synthetic construct
  REGION 1..15: note = Synthetic
YPFRLPIKGVPIELQ

SEQ ID NO: 1702 - protein, 9 aa, synthetic construct
  REGION 1..9: note = Synthetic
YPLLWSYAM

SEQ ID NO: 1703 - protein, 7 aa, synthetic construct
  REGION 1..7: note = Synthetic
YQQQGRL

SEQ ID NO: 1704 - protein, 10 aa, synthetic construct
  REGION 1..10: note = Synthetic
YQSEYLAHRR

SEQ ID NO: 1705 - protein, 15 aa, synthetic construct
  REGION 1..15: note = Synthetic
YRETGPSRASDARAA

SEQ ID NO: 1706 - protein, 20 aa, synthetic construct
  REGION 1..20: note = Synthetic
YRETGPSRASDARAAHLPTG

SEQ ID NO: 1707 - protein, 25 aa, synthetic construct
  REGION 1..25: note = Synthetic
YRNASDVLPGHWLQGGWGCYNLSDW

SEQ ID NO: 1708 - protein, 15 aa, synthetic construct
  REGION 1..15: note = Synthetic
YRRLLRTVLEPIRDA

SEQ ID NO: 1709 - protein, 8 aa, synthetic construct
  REGION 1..8: note = Synthetic
YRYDSRPP

SEQ ID NO: 1710 - protein, 15 aa, synthetic construct
  REGION 1..15: note = Synthetic
YSGGDLLGILESRGI

SEQ ID NO: 1711 - protein, 25 aa, synthetic construct
  REGION 1..25: note = Synthetic
YSKVTATBLLASTNSRLCAVFVRDG

SEQ ID NO: 1712 - protein, 15 aa, synthetic construct
  REGION 1..15: note = Synthetic
YSPSRSFSYFYPFRL

SEQ ID NO: 1713 - protein, 25 aa, synthetic construct
  REGION 1..25: note = Synthetic
YTGNQQSRWGLGSPNCHGPDWASPV

SEQ ID NO: 1714 - protein, 9 aa, synthetic construct
  REGION 1..9: note = Synthetic
YVLLAVLFV

SEQ ID NO: 1715 - protein, 15 aa, synthetic construct
  REGION 1..15: note = Synthetic
YVYSPGRSFSYFYPF

SEQ ID NO: 1716 - protein, 27 aa, synthetic construct
  REGION 1..27: note = Synthetic
YYDYEDATFQTYALTGISLCNPAASIC

SEQ ID NO: 1717 - protein, 15 aa, synthetic construct
  REGION 1..15: note = Synthetic
GDLLGILESRGIKAR

SEQ ID NO: 1718 - protein, 15 aa, synthetic construct
  REGION 1..15: note = Synthetic
TVPKYVATQGYLISN

SEQ ID NO: 1719 - protein, 9 aa, synthetic construct
  REGION 1..9: note = Synthetic
KPWDSPQEI

SEQ ID NO: 1720 - protein, 9 aa, synthetic construct
  REGION 1..9: note = Synthetic
KPWESPQEI

SEQ ID NO: 1721 - protein, 15 aa, synthetic construct
  REGION 1..15: note = Synthetic
ATYQSEYLAHRRIPP

SEQ ID NO: 1722 - protein, 35 aa, synthetic construct
  REGION 1..35: note = Synthetic
CMARQAESSEAMAAWSERAGEAMVLVYYESIAYSF

SEQ ID NO: 1723 - protein, 24 aa, synthetic construct
  REGION 1..24: note = Synthetic
CQVGSSNSAFVSTSSSRRYTEVYL

SEQ ID NO: 1724 - protein, 15 aa, synthetic construct
  REGION 1..15: note = Synthetic
DDPPATVYRYDSRPP

SEQ ID NO: 1725 - protein, 18 aa, synthetic construct
  REGION 1..18: note = Synthetic
GALATYQSEYLAHRRIPP

SEQ ID NO: 1726 - protein, 24 aa, synthetic construct
  REGION 1..24: note = Synthetic
MAAWSERAGEAMVLVYYESIAYSF

SEQ ID NO: 1727 - protein, 13 aa, synthetic construct
  REGION 1..13: note = Synthetic
MVLVYYESIAYSF

SEQ ID NO: 1728 - protein, 15 aa, synthetic construct
  REGION 1..15: note = Synthetic
PATVYRYDSRPPEDV

SEQ ID NO: 1729 - protein, 9 aa, synthetic construct
  REGION 1..9: note = Synthetic
YDSRPPEDV

SEQ ID NO: 1730 - protein, 10 aa, synthetic construct
  REGION 1..10: note = Synthetic
EPGITTNYDT

SEQ ID NO: 1731 - protein, 20 aa, synthetic construct
  REGION 1..20: note = Synthetic
GDLRAYKMVYATNPQTQLSN

SEQ ID NO: 1732 - protein, 21 aa, synthetic construct
  REGION 1..21: note = Synthetic
KNGDVEASAITTYVGFSVVYP

SEQ ID NO: 1733 - protein, 19 aa, synthetic construct
  REGION 1..19: note = Synthetic
KVTNGSKSYTLRYLASYVK

SEQ ID NO: 1734 - protein, 35 aa, synthetic construct
  REGION 1..35: note = Synthetic
QALGALKLYFEPGITTNYDTGDLIAYKQTYNASGN

SEQ ID NO: 1735 - protein, 10 aa, synthetic construct
  REGION 1..10: note = Synthetic
YATNPQTQLS

SEQ ID NO: 1736 - protein, 24 aa, synthetic construct
  REGION 1..24: note = Synthetic
DNENPLSGKAGGVVKVTYPGLTKV

SEQ ID NO: 1737 - protein, 17 aa, synthetic construct
  REGION 1..17: note = Synthetic
ENFSSYHGTKPGYVDSI

SEQ ID NO: 1738 - protein, 19 aa, synthetic construct
  REGION 1..19: note = Synthetic
KVDNAETIKKELGLSLTEP

SEQ ID NO: 1739 - protein, 21 aa, synthetic construct
  REGION 1..21: note = Synthetic
MEDLQKALEAQSRALRAGLAA

SEQ ID NO: 1740 - protein, 23 aa, synthetic construct
  REGION 1..23: note = Synthetic
QKGIQKPKSGTQGNYDDDWKGFY

SEQ ID NO: 1741 - protein, 34 aa, synthetic construct
  REGION 1..34: note = Synthetic
RTGAWQRKDWSRAPPPPEERQESRSQTPAPKPSR

SEQ ID NO: 1742 - protein, 29 aa, synthetic construct
  REGION 1..29: note = Synthetic
AAGASQSRRPRPPRHARAQHLPEMTPAVT

SEQ ID NO: 1743 - protein, 28 aa, synthetic construct
  REGION 1..28: note = Synthetic
CVTSWLWSEGEGAVFYRVDLHFINLGTP

SEQ ID NO: 1744 - protein, 27 aa, synthetic construct
  REGION 1..27: note = Synthetic
FRVGGTRWHRLLRMPVRGLDGDTAPLP

SEQ ID NO: 1745 - protein, 28 aa, synthetic construct
  REGION 1..28: note = Synthetic
GRKIRMRCRAIDGDVTFCRPKSPVYVGN

SEQ ID NO: 1746 - protein, 28 aa, synthetic construct
  REGION 1..28: note = Synthetic
GTPPLDEDGRWDPALMYNPCGPEPPAHV

SEQ ID NO: 1747 - protein, 54 aa, synthetic construct
  REGION 1..54: note = Synthetic
GVHANLHVAFHRSSSEKIHSNEISSDSIGVLGYQKTVDHTKVNSKLSLFFEIKS

SEQ ID NO: 1748 - protein, 30 aa, synthetic construct
  REGION 1..30: note = Synthetic
MASTTPITMEDLQKALEAQSRALRAGLAAG

SEQ ID NO: 1749 - protein, 34 aa, synthetic construct
  REGION 1..34: note = Synthetic
PELGPPTNPFQAAVARGLRPPLHDPDTEAPTEAC

SEQ ID NO: 1750 - protein, 26 aa, synthetic construct
  REGION 1..26: note = Synthetic
PLPPHTTERIETRSARHPWRIRFGAP

SEQ ID NO: 1751 - protein, 27 aa, synthetic construct
  REGION 1..27: note = Synthetic
SRAPPPPEERQESRSQTPAPKPSRAPP

SEQ ID NO: 1752 - protein, 28 aa, synthetic construct
  REGION 1..28: note = Synthetic
SRAPPQQPQPPRMQTGRGGSAPRPELGP

SEQ ID NO: 1753 - protein, 27 aa, synthetic construct
  REGION 1..27: note = Synthetic
TPAVTPEGPAPPRTGAWQRKDWSRAPP

SEQ ID NO: 1754 - protein, 29 aa, synthetic construct
  REGION 1..29: note = Synthetic
VRAYNQPAGDVRGVWGKGERTYAEQDFRV

SEQ ID NO: 1755 - protein, 20 aa, synthetic construct
  REGION 1..20: note = Synthetic
AFGHSDAACWGFPTDTVMSV

SEQ ID NO: 1756 - protein, 21 aa, synthetic construct
  REGION 1..21: note = Synthetic
CARIWNGTQRACTFWAVNAYS

SEQ ID NO: 1757 - protein, 22 aa, synthetic construct
  REGION 1..22: note = Synthetic
EEAFTYLCTAPGCATQTPVPVR

SEQ ID NO: 1758 - protein, 20 aa, synthetic construct
  REGION 1..20: note = Synthetic
FAPWDLEATGACICEIPTDV

SEQ ID NO: 1759 - protein, 17 aa, synthetic construct
  REGION 1..17: note = Synthetic
GEDVGAFPPGKFVTAAL

SEQ ID NO: 1760 - protein, 20 aa, synthetic construct
  REGION 1..20: note = Synthetic
GEVWVTPVIGSQARKCGLHI

SEQ ID NO: 1761 - protein, 20 aa, synthetic construct
  REGION 1..20: note = Synthetic
GQLEVQVPPDPGDLVEYIMN

SEQ ID NO: 1762 - protein, 20 aa, synthetic construct
  REGION 1..20: note = Synthetic
GSYYKQYHPTACEVEPAFGH

SEQ ID NO: 1763 - protein, 20 aa, synthetic construct
  REGION 1..20: note = Synthetic
IHAHTTSDPWHPPGPLGLKF

SEQ ID NO: 1764 - protein, 20 aa, synthetic construct
  REGION 1..20: note = Synthetic
IMNYTGNQQSRWGLGSPNCH

SEQ ID NO: 1765 - protein, 20 aa, synthetic construct
  REGION 1..20: note = Synthetic
LHIRAGPYGHATVEMPEWIH

SEQ ID NO: 1766 - protein, 20 aa, synthetic construct
  REGION 1..20: note = Synthetic
LKFKTVRPVALPRALAPPRN

SEQ ID NO: 1767 - protein, 22 aa, synthetic construct
  REGION 1..22: note = Synthetic
LNTPPPYQVSCGGESDRASAGH

SEQ ID NO: 1768 - protein, 20 aa, synthetic construct
  REGION 1..20: note = Synthetic
NCHGPDWASPVCQRHSPDCS

SEQ ID NO: 1769 - protein, 20 aa, synthetic construct
  REGION 1..20: note = Synthetic
PDCSRLVGATPERPRLRLVD

SEQ ID NO: 1770 - protein, 20 aa, synthetic construct
  REGION 1..20: note = Synthetic
PRNVRVTGCYQCGTPALVEG

SEQ ID NO: 1771 - protein, 21 aa, synthetic construct
  REGION 1..21: note = Synthetic
PTDVSCEGLGAWVPTAPCARI

SEQ ID NO: 1772 - protein, 20 aa, synthetic construct
  REGION 1..20: note = Synthetic
RLVDADDPLLRTAPGPGEVW

SEQ ID NO: 1773 - protein, 20 aa, synthetic construct
  REGION 1..20: note = Synthetic
SVFALASYVQHPHKTVRVKF

SEQ ID NO: 1774 - protein, 20 aa, synthetic construct
  REGION 1..20: note = Synthetic
VEGLAPGGGNCHLTVNGEDV

SEQ ID NO: 1775 - protein, 20 aa, synthetic construct
  REGION 1..20: note = Synthetic
VKFHTETRTVWQLSVAGVSC

SEQ ID NO: 1776 - protein, 20 aa, synthetic construct
  REGION 1..20: note = Synthetic
VPVRLAGVGFESKIVDGGCF

SEQ ID NO: 1777 - protein, 20 aa, synthetic construct
  REGION 1..20: note = Synthetic
VSCNVTTEHPFCNTPHGQLE

SEQ ID NO: 1778 - protein, 12 aa, synthetic construct
  REGION 1..12: note = Synthetic
AAASSPDAHVPF

SEQ ID NO: 1779 - protein, 7 aa, synthetic construct
  REGION 1..7: note = Synthetic
AASSPDA

SEQ ID NO: 1780 - protein, 12 aa, synthetic construct
  REGION 1..12: note = Synthetic
AKLGAAASSPDA

SEQ ID NO: 1781 - protein, 12 aa, synthetic construct
  REGION 1..12: note = Synthetic
AMKPYEVTPTRM

SEQ ID NO: 1782 - protein, 25 aa, synthetic construct
  REGION 1..25: note = Synthetic
AMTHLSPALADVPYVLVKTNMVVTS

SEQ ID NO: 1783 - protein, 12 aa, synthetic construct
  REGION 1..12: note = Synthetic
ASSPDAHVPFCF

SEQ ID NO: 1784 - protein, 25 aa, synthetic construct
  REGION 1..25: note = Synthetic
ASSPDAHVPFCFGKDLKRPGSSPME

SEQ ID NO: 1785 - protein, 12 aa, synthetic construct
  REGION 1..12: note = Synthetic
CFGKDLKRPGSS

SEQ ID NO: 1786 - protein, 25 aa, synthetic construct
  REGION 1..25: note = Synthetic
CFGKDLKRPGSSPMEVMLRAVFMQQ

SEQ ID NO: 1787 - protein, 12 aa, synthetic construct
  REGION 1..12: note = Synthetic
CGIAAKLGAAAS

SEQ ID NO: 1788 - protein, 25 aa, synthetic construct
  REGION 1..25: note = Synthetic
CGIAAKLGAAASSPDAHVPFCFGKD

SEQ ID NO: 1789 - protein, 12 aa, synthetic construct
  REGION 1..12: note = Synthetic
DAHVPFCFGKDL

SEQ ID NO: 1790 - protein, 12 aa, synthetic construct
  REGION 1..12: note = Synthetic
DLKRPGSSPMEV

SEQ ID NO: 1791 - protein, 12 aa, synthetic construct
  REGION 1..12: note = Synthetic
DVPYVLVKTNMV

SEQ ID NO: 1792 - protein, 26 aa, synthetic construct
  REGION 1..26: note = Synthetic
DVPYVLVKTNMVVTSVAMKPYEVTPT

SEQ ID NO: 1793 - protein, 12 aa, synthetic construct
  REGION 1..12: note = Synthetic
EVMLRAVFMQQR

SEQ ID NO: 1794 - protein, 12 aa, synthetic construct
  REGION 1..12: note = Synthetic
FEGKPALELIRM

SEQ ID NO: 1795 - protein, 12 aa, synthetic construct
  REGION 1..12: note = Synthetic
FLGPKQLTFEGK

SEQ ID NO: 1796 - protein, 25 aa, synthetic construct
  REGION 1..25: note = Synthetic
FLGPKQLTFEGKPALELIRMVECSG

SEQ ID NO: 1797 - protein, 17 aa, synthetic construct
  REGION 1..17: note = Synthetic
FMQQRPLRMFLGPKQLT

SEQ ID NO: 1798 - protein, 12 aa, synthetic construct
  REGION 1..12: note = Synthetic
GKDLKRPGSSPM

SEQ ID NO: 1799 - protein, 13 aa, synthetic construct
  REGION 1..13: note = Synthetic
GKDLKRPGSSPME

SEQ ID NO: 1800 - protein, 12 aa, synthetic construct
  REGION 1..12: note = Synthetic
GKPALELIRMVE

SEQ ID NO: 1801 - protein, 12 aa, synthetic construct
  REGION 1..12: note = Synthetic
GPKQLTFEGKPA

SEQ ID NO: 1802 - protein, 12 aa, synthetic construct
  REGION 1..12: note = Synthetic
HVPFCFGKDLKR

SEQ ID NO: 1803 - protein, 12 aa, synthetic construct
  REGION 1..12: note = Synthetic
IAAKLGAAASSP

SEQ ID NO: 1804 - protein, 12 aa, synthetic construct
  REGION 1..12: note = Synthetic
KPYEVTPTRMLV

SEQ ID NO: 1805 - protein, 12 aa, synthetic construct
  REGION 1..12: note = Synthetic
KQLTFEGKPALE

SEQ ID NO: 1806 - protein, 12 aa, synthetic construct
  REGION 1..12: note = Synthetic
KRPGSSPMEVML

SEQ ID NO: 1807 - protein, 12 aa, synthetic construct
  REGION 1..12: note = Synthetic
LELIRMVECSGK

SEQ ID NO: 1808 - protein, 12 aa, synthetic construct
  REGION 1..12: note = Synthetic
LGAAASSPDAHV

SEQ ID NO: 1809 - protein, 12 aa, synthetic construct
  REGION 1..12: note = Synthetic
LIRMVECSGKQD

SEQ ID NO: 1810 - protein, 12 aa, synthetic construct
  REGION 1..12: note = Synthetic
LVCGIAAKLGAA

SEQ ID NO: 1811 - protein, 11 aa, synthetic construct
  REGION 1..11: note = Synthetic
MKPYEVTPTRM

SEQ ID NO: 1812 - protein, 12 aa, synthetic construct
  REGION 1..12: note = Synthetic
MLRAVFMQQRPL

SEQ ID NO: 1813 - protein, 8 aa, synthetic construct
  REGION 1..8: note = Synthetic
MQQRPLRM

SEQ ID NO: 1814 - protein, 12 aa, synthetic construct
  REGION 1..12: note = Synthetic
MQQRPLRMFLGP

SEQ ID NO: 1815 - protein, 12 aa, synthetic construct
  REGION 1..12: note = Synthetic
MVVTSVAMKPYE

SEQ ID NO: 1816 - protein, 25 aa, synthetic construct
  REGION 1..25: note = Synthetic
MVVTSVAMKPYEVTPTRMLVCGIAA

SEQ ID NO: 1817 - protein, 12 aa, synthetic construct
  REGION 1..12: note = Synthetic
PALELIRMVECS

SEQ ID NO: 1818 - protein, 14 aa, synthetic construct
  REGION 1..14: note = Synthetic
PALELIRMVECSGK

SEQ ID NO: 1819 - protein, 12 aa, synthetic construct
  REGION 1..12: note = Synthetic
PFCFGKDLKRPG

SEQ ID NO: 1820 - protein, 12 aa, synthetic construct
  REGION 1..12: note = Synthetic
PGSSPMEVMLRA

SEQ ID NO: 1821 - protein, 14 aa, synthetic construct
  REGION 1..14: note = Synthetic
PGSSPMEVMLRAVF

SEQ ID NO: 1822 - protein, 9 aa, synthetic construct
  REGION 1..9: note = Synthetic
PKQLTFEGK

SEQ ID NO: 1823 - protein, 12 aa, synthetic construct
  REGION 1..12: note = Synthetic
PLRMFLGPKQLT

SEQ ID NO: 1824 - protein, 12 aa, synthetic construct
  REGION 1..12: note = Synthetic
PTRMLVCGIAAK

SEQ ID NO: 1825 - protein, 12 aa, synthetic construct
  REGION 1..12: note = Synthetic
PYVLVKTNMVVT

SEQ ID NO: 1826 - protein, 25 aa, synthetic construct
  REGION 1..25: note = Synthetic
QLTFEGKPALELIRMVECSGKQDCP

SEQ ID NO: 1827 - protein, 12 aa, synthetic construct
  REGION 1..12: note = Synthetic
QRPLRMFLGPKQ

SEQ ID NO: 1828 - protein, 12 aa, synthetic construct
  REGION 1..12: note = Synthetic
RAVFMQQRPLRM

SEQ ID NO: 1829 - protein, 12 aa, synthetic construct
  REGION 1..12: note = Synthetic
RMFLGPKQLTFE

SEQ ID NO: 1830 - protein, 12 aa, synthetic construct
  REGION 1..12: note = Synthetic
RMLVCGIAAKLG

SEQ ID NO: 1831 - protein, 12 aa, synthetic construct
  REGION 1..12: note = Synthetic
RMVECSGKQDCP

SEQ ID NO: 1832 - protein, 12 aa, synthetic construct
  REGION 1..12: note = Synthetic
SPDAHVPFCFGK

SEQ ID NO: 1833 - protein, 12 aa, synthetic construct
  REGION 1..12: note = Synthetic
SSPMEVMLRAVF

SEQ ID NO: 1834 - protein, 25 aa, synthetic construct
  REGION 1..25: note = Synthetic
SSPMEVMLRAVFMQQRPLRMFLGPK

SEQ ID NO: 1835 - protein, 12 aa, synthetic construct
  REGION 1..12: note = Synthetic
SVAMKPYEVTPT

SEQ ID NO: 1836 - protein, 10 aa, synthetic construct
  REGION 1..10: note = Synthetic
VECSGKQDCP

SEQ ID NO: 1837 - protein, 12 aa, synthetic construct
  REGION 1..12: note = Synthetic
VFMQQRPLRMFL

SEQ ID NO: 1838 - protein, 25 aa, synthetic construct
  REGION 1..25: note = Synthetic
VFMQQRPLRMFLGPKQLTFEGKPAL

SEQ ID NO: 1839 - protein, 12 aa, synthetic construct
  REGION 1..12: note = Synthetic
VKTNMVVTSVAM

SEQ ID NO: 1840 - protein, 12 aa, synthetic construct
  REGION 1..12: note = Synthetic
VLVKTNMVVTSV

SEQ ID NO: 1841 - protein, 12 aa, synthetic construct
  REGION 1..12: note = Synthetic
VTPTRMLVCGIA

SEQ ID NO: 1842 - protein, 12 aa, synthetic construct
  REGION 1..12: note = Synthetic
VTSVAMKPYEVT

SEQ ID NO: 1843 - protein, 12 aa, synthetic construct
  REGION 1..12: note = Synthetic
YEVTPTRMLVCG

SEQ ID NO: 1844 - protein, 25 aa, synthetic construct
  REGION 1..25: note = Synthetic
YEVTPTRMLVCGIAAKLGAAASSPD

SEQ ID NO: 1845 - protein, 17 aa, synthetic construct
  REGION 1..17: note = Synthetic
CASPYEGRYRDMYDALR

SEQ ID NO: 1846 - protein, 11 aa, synthetic construct
  REGION 1..11: note = Synthetic
CAVFVRDGQSV

SEQ ID NO: 1847 - protein, 9 aa, synthetic construct
  REGION 1..9: note = Synthetic
CITTIYKTG

SEQ ID NO: 1848 - protein, 10 aa, synthetic construct
  REGION 1..10: note = Synthetic
CPNGTRALTV

SEQ ID NO: 1849 - protein, 14 aa, synthetic construct
  REGION 1..14: note = Synthetic
DALRRLLYMIYMSG

SEQ ID NO: 1850 - protein, 26 aa, synthetic construct
  REGION 1..26: note = Synthetic
GNRGRGQRRDWSRAPPPPEERQETRS

SEQ ID NO: 1851 - protein, 13 aa, synthetic construct
  REGION 1..13: note = Synthetic
GQPAADHYYSKVT

SEQ ID NO: 1852 - protein, 19 aa, synthetic construct
  REGION 1..19: note = Synthetic
GSPNCHGPDWASPVCQRHS

SEQ ID NO: 1853 - protein, 17 aa, synthetic construct
  REGION 1..17: note = Synthetic
HKSLSTNLDVTNSIEHQ

SEQ ID NO: 1854 - protein, 12 aa, synthetic construct
  REGION 1..12: note = Synthetic
LFTQQGGAYGRC

SEQ ID NO: 1855 - protein, 22 aa, synthetic construct
  REGION 1..22: note = Synthetic
LIGLLAIAGIRLHRAAIYTAEI

SEQ ID NO: 1856 - protein, 15 aa, synthetic construct
  REGION 1..15: note = Synthetic
PDTAADSELRRWIKY

SEQ ID NO: 1857 - protein, 17 aa, synthetic construct
  REGION 1..17: note = Synthetic
PNCHGPDWASPVCQRHS

SEQ ID NO: 1858 - protein, 24 aa, synthetic construct
  REGION 1..24: note = Synthetic
QTPAPKPSRAPPQQPQPPRMQTGR

SEQ ID NO: 1859 - protein, 18 aa, synthetic construct
  REGION 1..18: note = Synthetic
RAGLTAGASQSRRPRPPR

SEQ ID NO: 1860 - protein, 24 aa, synthetic construct
  REGION 1..24: note = Synthetic
RFGAPQAFLAGLLLAAVAVGTARA

SEQ ID NO: 1861 - protein, 16 aa, synthetic construct
  REGION 1..16: note = Synthetic
RGNAELQTYLRQITPG

SEQ ID NO: 1862 - protein, 15 aa, synthetic construct
  REGION 1..15: note = Synthetic
RVHVSKEEQYYDYED

SEQ ID NO: 1863 - protein, 11 aa, synthetic construct
  REGION 1..11: note = Synthetic
SIYGLYDGTYL

SEQ ID NO: 1864 - protein, 14 aa, synthetic construct
  REGION 1..14: note = Synthetic
SKVTATRLLASTNS

SEQ ID NO: 1865 - protein, 16 aa, synthetic construct
  REGION 1..16: note = Synthetic
TQQGGAYGRCPNGTRA

SEQ ID NO: 1866 - protein, 12 aa, synthetic construct
  REGION 1..12: note = Synthetic
VAPGIVIPPKAL

SEQ ID NO: 1867 - protein, 17 aa, synthetic construct
  REGION 1..17: note = Synthetic
DSRPPEDVFQNGFTAWG

SEQ ID NO: 1868 - protein, 15 aa, synthetic construct
  REGION 1..15: note = Synthetic
EHRMQEAVEAERAGR

SEQ ID NO: 1869 - protein, 22 aa, synthetic construct
  REGION 1..22: note = Synthetic
ETCFQQACKGKIQALCENPEWA

SEQ ID NO: 1870 - protein, 22 aa, synthetic construct
  REGION 1..22: note = Synthetic
EYVDTYGDNAGRILAGALATYQ

SEQ ID NO: 1871 - protein, 14 aa, synthetic construct
  REGION 1..14: note = Synthetic
HRRIPPENIRRVTR

SEQ ID NO: 1872 - protein, 9 aa, synthetic construct
  REGION 1..9: note = Synthetic
MARQAESSE

SEQ ID NO: 1873 - protein, 12 aa, synthetic construct
  REGION 1..12: note = Synthetic
MQEAVEAERAGR

SEQ ID NO: 1874 - protein, 15 aa, synthetic construct
  REGION 1..15: note = Synthetic
SQQTRANPNPYTSRR

SEQ ID NO: 1875 - protein, 24 aa, synthetic construct
  REGION 1..24: note = Synthetic
TRANPNPYTSRRSVASIVGTLVHG

SEQ ID NO: 1876 - protein, 12 aa, synthetic construct
  REGION 1..12: note = Synthetic
TVYRYDSRPPED

SEQ ID NO: 1877 - protein, 7 aa, synthetic construct
  REGION 1..7: note = Synthetic
NDRNLLD

SEQ ID NO: 1878 - protein, 29 aa, synthetic construct
  REGION 1..29: note = Synthetic
NMEDEADQYFSHDDPISSDQSRFGWFENK

SEQ ID NO: 1879 - protein, 20 aa, synthetic construct
  REGION 1..20: note = Synthetic
SRASDARAAHLPTGTPLDID

SEQ ID NO: 1880 - protein, 11 aa, synthetic construct
  REGION 1..11: note = Synthetic
EDVFQNGFTAW

SEQ ID NO: 1881 - protein, 17 aa, synthetic construct
  REGION 1..17: note = Synthetic
AEGSSSVEYINNWEQAK

SEQ ID NO: 1882 - protein, 14 aa, synthetic construct
  REGION 1..14: note = Synthetic
GPIKNKMSESPNKT

SEQ ID NO: 1883 - protein, 32 aa, synthetic construct
  REGION 1..32: note = Synthetic
GPKLTGALIGILSLFVESPGQLIQRITDDPDV

SEQ ID NO: 1884 - protein, 14 aa, synthetic construct
  REGION 1..14: note = Synthetic
GYQKTVDHTKVNSK

SEQ ID NO: 1885 - protein, 5 aa, synthetic construct
  REGION 1..5: note = Synthetic
KTVDH

SEQ ID NO: 1886 - protein, 6 aa, synthetic construct
  REGION 1..6: note = Synthetic
SESPNK

SEQ ID NO: 1887 - protein, 20 aa, synthetic construct
  REGION 1..20: note = Synthetic
AEGSSSVEYINNWEQAKALS

SEQ ID NO: 1888 - protein, 20 aa, synthetic construct
  REGION 1..20: note = Synthetic
AQAIPLVGELVDIGFAAYNF

SEQ ID NO: 1889 - protein, 20 aa, synthetic construct
  REGION 1..20: note = Synthetic
ASRVVLSLPFAEGSSSVEYI

SEQ ID NO: 1890 - protein, 20 aa, synthetic construct
  REGION 1..20: note = Synthetic
CINLDWDVIRDKTKTKIESL

SEQ ID NO: 1891 - protein, 20 aa, synthetic construct
  REGION 1..20: note = Synthetic
CRAIDGDVTFCRPKSPVYVG

SEQ ID NO: 1892 - protein, 20 aa, synthetic construct
  REGION 1..20: note = Synthetic
CRPKSPVYVGNGVHANLHVA

SEQ ID NO: 1893 - protein, 20 aa, synthetic construct
  REGION 1..20: note = Synthetic
DAAGYSVDNENPLSGKAGGV

SEQ ID NO: 1894 - protein, 20 aa, synthetic construct
  REGION 1..20: note = Synthetic
DKTKTKIESLKEHGPIKNKM

SEQ ID NO: 1895 - protein, 20 aa, synthetic construct
  REGION 1..20: note = Synthetic
EEFIKRFGDGASRVVLSLPF

SEQ ID NO: 1896 - protein, 20 aa, synthetic construct
  REGION 1..20: note = Synthetic
EKAKQYLEEFHQTALEHPEL

SEQ ID NO: 1897 - protein, 20 aa, synthetic construct
  REGION 1..20: note = Synthetic
FHRSSSEKIHSNEISSDSIG

SEQ ID NO: 1898 - protein, 20 aa, synthetic construct
  REGION 1..20: note = Synthetic
GADDVVDSSKSFVMENFSSY

SEQ ID NO: 1899 - protein, 20 aa, synthetic construct
  REGION 1..20: note = Synthetic
GKRGQDAMYEYMAQACAGNR

SEQ ID NO: 1900 - protein, 20 aa, synthetic construct
  REGION 1..20: note = Synthetic
GSVMGIADGAVHHNTEEIVA

SEQ ID NO: 1901 - protein, 20 aa, synthetic construct
  REGION 1..20: note = Synthetic
GTQGNYDDDWKGFYSTDNKY

SEQ ID NO: 1902 - protein, 20 aa, synthetic construct
  REGION 1..20: note = Synthetic
HDGYAVSWNTVEDSIIRTGF

SEQ ID NO: 1903 - protein, 20 aa, synthetic construct
  REGION 1..20: note = Synthetic
HGTKPGYVDSIQKGIQKPKS

SEQ ID NO: 1904 - protein, 20 aa, synthetic construct
  REGION 1..20: note = Synthetic
HQTALEHPELSELKTVTGTN

SEQ ID NO: 1905 - protein, 20 aa, synthetic construct
  REGION 1..20: note = Synthetic
IQKGIQKPKSGTQGNYDDDW

SEQ ID NO: 1906 - protein, 20 aa, synthetic construct
  REGION 1..20: note = Synthetic
KEHGPIKNKMSESPNKTVSE

SEQ ID NO: 1907 - protein, 20 aa, synthetic construct
  REGION 1..20: note = Synthetic
KGFYSTDNKYDAAGYSVDNE

SEQ ID NO: 1908 - protein, 20 aa, synthetic construct
  REGION 1..20: note = Synthetic
LDVNKSKTHISVNGRKIRMR

SEQ ID NO: 1909 - protein, 18 aa, synthetic construct
  REGION 1..18: note = Synthetic
MASTIPITMEDLQKALEA

SEQ ID NO: 1910 - protein, 20 aa, synthetic construct
  REGION 1..20: note = Synthetic
NGVHANLHVAFHRSSSEKIH

SEQ ID NO: 1911 - protein, 20 aa, synthetic construct
  REGION 1..20: note = Synthetic
NNWEQAKALSVELEINFETR

SEQ ID NO: 1912 - protein, 20 aa, synthetic construct
  REGION 1..20: note = Synthetic
NPLSGKAGGVVKVTYPGLTK

SEQ ID NO: 1913 - protein, 20 aa, synthetic construct
  REGION 1..20: note = Synthetic
PVFAGANYAAWAVNVAQVID

SEQ ID NO: 1914 - protein, 20 aa, synthetic construct
  REGION 1..20: note = Synthetic
SELKTVTGTNPVFAGANYAA

SEQ ID NO: 1915 - protein, 20 aa, synthetic construct
  REGION 1..20: note = Synthetic
SESPNKTVSEEKAKQYLEEF

SEQ ID NO: 1916 - protein, 20 aa, synthetic construct
  REGION 1..20: note = Synthetic
SETADNLEKTTAALSILPGI

SEQ ID NO: 1917 - protein, 20 aa, synthetic construct
  REGION 1..20: note = Synthetic
SFVMENFSSYHGTKPGYVDS

SEQ ID NO: 1918 - protein, 20 aa, synthetic construct
  REGION 1..20: note = Synthetic
SNEISSDSIGVLGYQKTVDH

SEQ ID NO: 1919 - protein, 20 aa, synthetic construct
  REGION 1..20: note = Synthetic
SPGHKTQPFLHDGYAVSWNT

SEQ ID NO: 1920 - protein, 20 aa, synthetic construct
  REGION 1..20: note = Synthetic
SVNGRKIRMRCRAIDGDVTF

SEQ ID NO: 1921 - protein, 20 aa, synthetic construct
  REGION 1..20: note = Synthetic
TAALSILPGIGSVMGIADGA

SEQ ID NO: 1922 - protein, 20 aa, synthetic construct
  REGION 1..20: note = Synthetic
TAENTPLPIAGVLLPTIPGK

SEQ ID NO: 1923 - protein, 20 aa, synthetic construct
  REGION 1..20: note = Synthetic
TEPLMEQVGTEEFIKRFGDG

SEQ ID NO: 1924 - protein, 20 aa, synthetic construct
  REGION 1..20: note = Synthetic
TIKKELGLSLTEPLMEQVGT

SEQ ID NO: 1925 - protein, 15 aa, synthetic construct
  REGION 1..15: note = Synthetic
TKVNSKLSLFFEIKS

SEQ ID NO: 1926 - protein, 20 aa, synthetic construct
  REGION 1..20: note = Synthetic
VEDSIIRTGFQGESGHDIKI

SEQ ID NO: 1927 - protein, 20 aa, synthetic construct
  REGION 1..20: note = Synthetic
VELEINFETRGKRGQDAMYE

SEQ ID NO: 1928 - protein, 20 aa, synthetic construct
  REGION 1..20: note = Synthetic
VESIINLFQVVHNSYNRPAY

SEQ ID NO: 1929 - protein, 20 aa, synthetic construct
  REGION 1..20: note = Synthetic
VHNSYNRPAYSPGHKTQPFL

SEQ ID NO: 1930 - protein, 20 aa, synthetic construct
  REGION 1..20: note = Synthetic
VKVTYPGLTKVLALKVDNAE

SEQ ID NO: 1931 - protein, 20 aa, synthetic construct
  REGION 1..20: note = Synthetic
VLALKVDNAETIKKELGLSL

SEQ ID NO: 1932 - protein, 20 aa, synthetic construct
  REGION 1..20: note = Synthetic
VLGYQKTVDHTKVNSKLSLF

SEQ ID NO: 1933 - protein, 20 aa, synthetic construct
  REGION 1..20: note = Synthetic
VRRSVGSSLSCINLDWDVIR

SEQ ID NO: 1934 - protein, 20 aa, synthetic construct
  REGION 1..20: note = Synthetic
WAVNVAQVIDSETADNLEKT

SEQ ID NO: 1935 - protein, 20 aa, synthetic construct
  REGION 1..20: note = Synthetic
YMAQACAGNRVRRSVGSSLS

SEQ ID NO: 1936 - protein, 15 aa, synthetic construct
  REGION 1..15: note = Synthetic
AKAPPAPKPAPQPGP

SEQ ID NO: 1937 - protein, 10 aa, synthetic construct
  REGION 1..10: note = Synthetic
APKPAPQPGP

SEQ ID NO: 1938 - protein, 15 aa, synthetic construct
  REGION 1..15: note = Synthetic
APKPAPQPGPQPPQP

SEQ ID NO: 1939 - protein, 15 aa, synthetic construct
  REGION 1..15: note = Synthetic
AQTRTPLQCTMTEIF

SEQ ID NO: 1940 - protein, 19 aa, synthetic construct
  REGION 1..19: note = Synthetic
ASRGTNMEDEADQYFSHDD

SEQ ID NO: 1941 - protein, 5 aa, synthetic construct
  REGION 1..5: note = Synthetic
ATIRR

SEQ ID NO: 1942 - protein, 5 aa, synthetic construct
  REGION 1..5: note = Synthetic
DNRAG

SEQ ID NO: 1943 - protein, 15 aa, synthetic construct
  REGION 1..15: note = Synthetic
EAPAPQPPAGRELSA

SEQ ID NO: 1944 - protein, 20 aa, synthetic construct
  REGION 1..20: note = Synthetic
EMVRRSAGKVSSTLASELGI

SEQ ID NO: 1945 - protein, 5 aa, synthetic construct
  REGION 1..5: note = Synthetic
GASEL

SEQ ID NO: 1946 - protein, 10 aa, synthetic construct
  REGION 1..10: note = Synthetic
GDALAGGAVP

SEQ ID NO: 1947 - protein, 10 aa, synthetic construct
  REGION 1..10: note = Synthetic
GDAPAGGAVP

SEQ ID NO: 1948 - protein, 7 aa, synthetic construct
  REGION 1..7: note = Synthetic
GDTWDDD

SEQ ID NO: 1949 - protein, 5 aa, synthetic construct
  REGION 1..5: note = Synthetic
GERQH

SEQ ID NO: 1950 - protein, 5 aa, synthetic construct
  REGION 1..5: note = Synthetic
GGAVP

SEQ ID NO: 1951 - protein, 5 aa, synthetic construct
  REGION 1..5: note = Synthetic
GGFGP

SEQ ID NO: 1952 - protein, 10 aa, synthetic construct
  REGION 1..10: note = Synthetic
GGFGPGGFGP

SEQ ID NO: 1953 - protein, 10 aa, synthetic construct
  REGION 1..10: note = Synthetic
GGFGPVLDGW

SEQ ID NO: 1954 - protein, 20 aa, synthetic construct
  REGION 1..20: note = Synthetic
GGKEDRRVKQSRGEARESYR

SEQ ID NO: 1955 - protein, 6 aa, synthetic construct
  REGION 1..6: note = Synthetic
GILLEN

SEQ ID NO: 1956 - protein, 6 aa, synthetic construct
  REGION 1..6: note = Synthetic
GIRRFL

SEQ ID NO: 1957 - protein, 20 aa, synthetic construct
  REGION 1..20: note = Synthetic
HDDPISSDQSRFGWFENKEI

SEQ ID NO: 1958 - protein, 17 aa, synthetic construct
  REGION 1..17: note = Synthetic
HEFAGELSTLESLMNLY

SEQ ID NO: 1959 - protein, 8 aa, synthetic construct
  REGION 1..8: note = Synthetic
HLGGLAGY

SEQ ID NO: 1960 - protein, 21 aa, synthetic construct
  REGION 1..21: note = Synthetic
HTTEDKISRAVGPRQAQVSFL

SEQ ID NO: 1961 - protein, 20 aa, synthetic construct
  REGION 1..20: note = Synthetic
ICDIDTYIVEAGLASFILTI

SEQ ID NO: 1962 - protein, 20 aa, synthetic construct
  REGION 1..20: note = Synthetic
IIIVPIPGDSSITTRSRLLD

SEQ ID NO: 1963 - protein, 20 aa, synthetic construct
  REGION 1..20: note = Synthetic
ILDIKRTPGNKPRIAEMICD

SEQ ID NO: 1964 - protein, 6 aa, synthetic construct
  REGION 1..6: note = Synthetic
KALLYR

SEQ ID NO: 1965 - protein, 20 aa, synthetic construct
  REGION 1..20: note = Synthetic
KPPITSGSGGAIRGIKHIII

SEQ ID NO: 1966 - protein, 6 aa, synthetic construct
  REGION 1..6: note = Synthetic
LAGSGL

SEQ ID NO: 1967 - protein, 20 aa, synthetic construct
  REGION 1..20: note = Synthetic
LGITAEDARLVSEIAMHTTE

SEQ ID NO: 1968 - protein, 18 aa, synthetic construct
  REGION 1..18: note = Synthetic
LGTILAQIWVLLAKAVTA

SEQ ID NO: 1969 - protein, 18 aa, synthetic construct
  REGION 1..18: note = Synthetic
LPTGTPLDIDTASESSQD

SEQ ID NO: 1970 - protein, 17 aa, synthetic construct
  REGION 1..17: note = Synthetic
MATLLRSLALFKRNKDK

SEQ ID NO: 1971 - protein, 6 aa, synthetic construct
  REGION 1..6: note = Synthetic
PAPQPP

SEQ ID NO: 1972 - protein, 20 aa, synthetic construct
  REGION 1..20: note = Synthetic
PDTAADSELRRWIKYTQQRR

SEQ ID NO: 1973 - protein, 20 aa, synthetic construct
  REGION 1..20: note = Synthetic
PKLTGALIGILSLFVESPGQ

SEQ ID NO: 1974 - skipped

SEQ ID NO: 1975 - protein, 5 aa, synthetic construct
  REGION 1..5: note = Synthetic
PQPGP

SEQ ID NO: 1976 - protein, 15 aa, synthetic construct
  REGION 1..15: note = Synthetic
PQPGPQPPQPPQPQP

SEQ ID NO: 1977 - protein, 20 aa, synthetic construct
  REGION 1..20: note = Synthetic
QDPQDSRRSAEPLLSCKPWQ

SEQ ID NO: 1978 - protein, 19 aa, synthetic construct
  REGION 1..19: note = Synthetic
QRRVVGEFRLERKWLDVVR

SEQ ID NO: 1979 - protein, 5 aa, synthetic construct
  REGION 1..5: note = Synthetic
RELSA

SEQ ID NO: 1980 - protein, 5 aa, synthetic construct
  REGION 1..5: note = Synthetic
RFAPQ

SEQ ID NO: 1981 - protein, 20 aa, synthetic construct
  REGION 1..20: note = Synthetic
SIQNKFSAGSYPLLWSYAMG

SEQ ID NO: 1982 - protein, 9 aa, synthetic construct
  REGION 1..9: note = Synthetic
SITLQAGAH

SEQ ID NO: 1983 - protein, 6 aa, synthetic construct
  REGION 1..6: note = Synthetic
SLQPED

SEQ ID NO: 1984 - protein, 8 aa, synthetic construct
  REGION 1..8: note = Synthetic
SNALSKRL

SEQ ID NO: 1985 - protein, 20 aa, synthetic construct
  REGION 1..20: note = Synthetic
SPGQLIQRITDDPDVSIRLL

SEQ ID NO: 1986 - protein, 8 aa, synthetic construct
  REGION 1..8: note = Synthetic
TELPSIPG

SEQ ID NO: 1987 - protein, 7 aa, synthetic construct
  REGION 1..7: note = Synthetic
TFTLANK

SEQ ID NO: 1988 - protein, 5 aa, synthetic construct
  REGION 1..5: note = Synthetic
TWDDD

SEQ ID NO: 1989 - protein, 20 aa, synthetic construct
  REGION 1..20: note = Synthetic
VSFLQGDQSENELPRLGGKE

SEQ ID NO: 1990 - protein, 17 aa, synthetic construct
  REGION 1..17: note = Synthetic
WQESRKNKAQTRTPLQC

SEQ ID NO: 1991 - protein, 20 aa, synthetic construct
  REGION 1..20: note = Synthetic
YAMGVGVELENSMGGLNFGR

SEQ ID NO: 1992 - protein, 18 aa, synthetic construct
  REGION 1..18: note = Synthetic
YQQMGKPAPYMVNLENSI

SEQ ID NO: 1993 - protein, 15 aa, synthetic construct
  REGION 1..15: note = Synthetic
MTRSSHQSLVIKLMP

SEQ ID NO: 1994 - protein, 15 aa, synthetic construct
  REGION 1..15: note = Synthetic
PIRDALNAMTQNIRP

SEQ ID NO: 1995 - protein, 24 aa, synthetic construct
  REGION 1..24: note = Synthetic
ALLNTPPPYQVSCGGESDRASAGH

SEQ ID NO: 1996 - protein, 21 aa, synthetic construct
  REGION 1..21: note = Synthetic
GLGSPNCHGPDWASPVCQRHS

SEQ ID NO: 1997 - protein, 28 aa, synthetic construct
  REGION 1..28: note = Synthetic
GLGSPNCHGPDWASPVCQRHSPDCSRLV

SEQ ID NO: 1998 - protein, 26 aa, synthetic construct
  REGION 1..26: note = Synthetic
NYTGNQQSRWGLGSPNCHGPDWASPV

SEQ ID NO: 1999 - protein, 20 aa, synthetic construct
  REGION 1..20: note = Synthetic
TLPQPPCAHGQHYGHHHHQL

SEQ ID NO: 2000 - protein, 26 aa, synthetic construct
  REGION 1..26: note = Synthetic
TVRVKFHTETRTVWQLSVAGVSCNVT

SEQ ID NO: 2001 - protein, 15 aa, synthetic construct
  REGION 1..15: note = Synthetic
ASYFNPGGSYYKQYH

SEQ ID NO: 2002 - protein, 15 aa, synthetic construct
  REGION 1..15: note = Synthetic
FALASYVQHPHKTVR

SEQ ID NO: 2003 - protein, 21 aa, synthetic construct
  REGION 1..21: note = Synthetic
GGESDRASARVIDPAAQSFTG

SEQ ID NO: 2004 - protein, 18 aa, synthetic construct
  REGION 1..18: note = Synthetic
GPGEVWVTPVIGSQARKC

SEQ ID NO: 2005 - protein, 14 aa, synthetic construct
  REGION 1..14: note = Synthetic
GSQARKCGLHIRAG

SEQ ID NO: 2006 - protein, 25 aa, synthetic construct
  REGION 1..25: note = Synthetic
LVGATPERPRLRLVDADDPLLRTAP

SEQ ID NO: 2007 - protein, 14 aa, synthetic construct
  REGION 1..14: note = Synthetic
TAPGPGEVWVTPVI

SEQ ID NO: 2008 - protein, 15 aa, synthetic construct
  REGION 1..15: note = Synthetic
FIVLSIAYPTLSEIK

SEQ ID NO: 2009 - protein, 32 aa, synthetic construct
  REGION 1..32: note = Synthetic
ETCFQQACKGKIQALCENPEWAPLKDNRIPSY

SEQ ID NO: 2010 - protein, 10 aa, synthetic construct
  REGION 1..10: note = Synthetic
LPRLGGKEDR

SEQ ID NO: 2011 - protein, 10 aa, synthetic construct
  REGION 1..10: note = Synthetic
MSKTEWNASQ

SEQ ID NO: 2012 - protein, 10 aa, synthetic construct
  REGION 1..10: note = Synthetic
SRFGWFENKE

SEQ ID NO: 2013 - protein, 29 aa, synthetic construct
  REGION 1..29: note = Synthetic
EACVTSWLWSEGEGAVFYRVDLHFINLGT

SEQ ID NO: 2014 - protein, 21 aa, synthetic construct
  REGION 1..21: note = Synthetic
MDFWCVEHDRPPPATPTSLTT

SEQ ID NO: 2015 - protein, 25 aa, synthetic construct
  REGION 1..25: note = Synthetic
PFLGHDGHHGGTLRVGQHHRNASDV

SEQ ID NO: 2016 - protein, 21 aa, synthetic construct
  REGION 1..21: note = Synthetic
RVKFHTETRTVWQLSVAGVSC

SEQ ID NO: 2017 - protein, 13 aa, synthetic construct
  REGION 1..13: note = Synthetic
AEEQARHVKNGLE

SEQ ID NO: 2018 - protein, 13 aa, synthetic construct
  REGION 1..13: note = Synthetic
ESPQEISKHQALG

SEQ ID NO: 2019 - protein, 15 aa, synthetic construct
  REGION 1..15: note = Synthetic
GVGVELENSMGGLNF

SEQ ID NO: 2020 - protein, 20 aa, synthetic construct
  REGION 1..20: note = Synthetic
IKGANDLAKFHQMLMKIIMK

SEQ ID NO: 2021 - protein, 14 aa, synthetic construct
  REGION 1..14: note = Synthetic
MSKTLHAQLGFKKT

SEQ ID NO: 2022 - protein, 13 aa, synthetic construct
  REGION 1..13: note = Synthetic
NASGLSRPSPSAH

SEQ ID NO: 2023 - protein, 14 aa, synthetic construct
  REGION 1..14: note = Synthetic
VRVIDPSLGDRKDE

SEQ ID NO: 2024 - protein, 9 aa, synthetic construct
  REGION 1..9: note = Synthetic
DLSDGDLLV

SEQ ID NO: 2025 - protein, 10 aa, synthetic construct
  REGION 1..10: note = Synthetic
EAERAGRGTG

SEQ ID NO: 2026 - protein, 11 aa, synthetic construct
  REGION 1..11: note = Synthetic
YRYDSRPPEDV

SEQ ID NO: 2027 - protein, 10 aa, synthetic construct
  REGION 1..10: note = Synthetic
YVDTYGDNAG

SEQ ID NO: 2028 - protein, 9 aa, synthetic construct
  REGION 1..9: note = Synthetic
SFSYFYPFR

SEQ ID NO: 2029 - protein, 8 aa, synthetic construct
  REGION 1..8: note = Synthetic
DIFIVSPR

SEQ ID NO: 2030 - protein, 37 aa, synthetic construct
  REGION 1..37: note = Synthetic
QDSRRSADALLRLQAMAGISEEQGSDTDTPIVYNDRN

SEQ ID NO: 2031 - protein, 10 aa, synthetic construct
  REGION 1..10: note = Synthetic
SAEALLRLQA

SEQ ID NO: 2032 - protein, 9 aa, synthetic construct
  REGION 1..9: note = Synthetic
RIVINREHL

SEQ ID NO: 2033 - protein, 5 aa, synthetic construct
  REGION 1..5: note = Synthetic
IPRFK

SEQ ID NO: 2034 - protein, 9 aa, synthetic construct
  REGION 1..9: note = Synthetic
AAALSPMEI

SEQ ID NO: 2035 - protein, 10 aa, synthetic construct
  REGION 1..10: note = Synthetic
AAASVVGAPV

SEQ ID NO: 2036 - protein, 9 aa, synthetic construct
  REGION 1..9: note = Synthetic
AALGRQDSI

SEQ ID NO: 2037 - protein, 10 aa, synthetic construct
  REGION 1..10: note = Synthetic
AAQRLVHAIA

SEQ ID NO: 2038 - protein, 8 aa, synthetic construct
  REGION 1..8: note = Synthetic
AAVEAAEL

SEQ ID NO: 2039 - protein, 9 aa, synthetic construct
  REGION 1..9: note = Synthetic
AGANVLNGL

SEQ ID NO: 2040 - protein, 8 aa, synthetic construct
  REGION 1..8: note = Synthetic
AGYANAAD

SEQ ID NO: 2041 - protein, 10 aa, synthetic construct
  REGION 1..10: note = Synthetic
AGYEQFEFRV

SEQ ID NO: 2042 - protein, 9 aa, synthetic construct
  REGION 1..9: note = Synthetic
AITGNADNL

SEQ ID NO: 2043 - protein, 9 aa, synthetic construct
  REGION 1..9: note = Synthetic
AKEKNATLM

SEQ ID NO: 2044 - protein, 8 aa, synthetic construct
  REGION 1..8: note = Synthetic
AKGVFLSL

SEQ ID NO: 2045 - protein, 9 aa, synthetic construct
  REGION 1..9: note = Synthetic
APHEYGFGI

SEQ ID NO: 2046 - protein, 9 aa, synthetic construct
  REGION 1..9: note = Synthetic
ARQGNDLEI

SEQ ID NO: 2047 - protein, 8 aa, synthetic construct
  REGION 1..8: note = Synthetic
ASVVGAPV

SEQ ID NO: 2048 - protein, 8 aa, synthetic construct
  REGION 1..8: note = Synthetic
ATLMFRLV

SEQ ID NO: 2049 - protein, 8 aa, synthetic construct
  REGION 1..8: note = Synthetic
AVAAAQRL

SEQ ID NO: 2050 - protein, 10 aa, synthetic construct
  REGION 1..10: note = Synthetic
DAGANVLNGL

SEQ ID NO: 2051 - protein, 9 aa, synthetic construct
  REGION 1..9: note = Synthetic
DALLAQLYR

SEQ ID NO: 2052 - protein, 10 aa, synthetic construct
  REGION 1..10: note = Synthetic
DANGVLKHSI

SEQ ID NO: 2053 - protein, 9 aa, synthetic construct
  REGION 1..9: note = Synthetic
DGDMNIGVI

SEQ ID NO: 2054 - protein, 9 aa, synthetic construct
  REGION 1..9: note = Synthetic
DHVKNIENL

SEQ ID NO: 2055 - protein, 8 aa, synthetic construct
  REGION 1..8: note = Synthetic
DIDMFAIM

SEQ ID NO: 2056 - protein, 9 aa, synthetic construct
  REGION 1..9: note = Synthetic
DMFAIMPHL

SEQ ID NO: 2057 - protein, 9 aa, synthetic construct
  REGION 1..9: note = Synthetic
DNVRNVENV

SEQ ID NO: 2058 - protein, 10 aa, synthetic construct
  REGION 1..10: note = Synthetic
DNVRNVENVI

SEQ ID NO: 2059 - protein, 8 aa, synthetic construct
  REGION 1..8: note = Synthetic
DTVDYSAM

SEQ ID NO: 2060 - protein, 9 aa, synthetic construct
  REGION 1..9: note = Synthetic
DTVDYSAMI

SEQ ID NO: 2061 - protein, 8 aa, synthetic construct
  REGION 1..8: note = Synthetic
DYLRQAGL

SEQ ID NO: 2062 - protein, 9 aa, synthetic construct
  REGION 1..9: note = Synthetic
DYYDNVRNV

SEQ ID NO: 2063 - protein, 8 aa, synthetic construct
  REGION 1..8: note = Synthetic
EFTTFVEI

SEQ ID NO: 2064 - protein, 9 aa, synthetic construct
  REGION 1..9: note = Synthetic
EFTTFVEIV

SEQ ID NO: 2065 - protein, 8 aa, synthetic construct
  REGION 1..8: note = Synthetic
EGYVFYEN

SEQ ID NO: 2066 - protein, 8 aa, synthetic construct
  REGION 1..8: note = Synthetic
ENVQYRHV

SEQ ID NO: 2067 - protein, 9 aa, synthetic construct
  REGION 1..9: note = Synthetic
EQLANSDGL

SEQ ID NO: 2068 - protein, 10 aa, synthetic construct
  REGION 1..10: note = Synthetic
FGVGYGHDTI

SEQ ID NO: 2069 - protein, 10 aa, synthetic construct
  REGION 1..10: note = Synthetic
FSPDVLETVP

SEQ ID NO: 2070 - protein, 9 aa, synthetic construct
  REGION 1..9: note = Synthetic
FSVDHVKNI

SEQ ID NO: 2071 - protein, 9 aa, synthetic construct
  REGION 1..9: note = Synthetic
GDDTYLFGV

SEQ ID NO: 2072 - protein, 9 aa, synthetic construct
  REGION 1..9: note = Synthetic
GDDVFLQDL

SEQ ID NO: 2073 - protein, 9 aa, synthetic construct
  REGION 1..9: note = Synthetic
GEDGNDIFL

SEQ ID NO: 2074 - protein, 10 aa, synthetic construct
  REGION 1..10: note = Synthetic
GERFNVRKQL

SEQ ID NO: 2075 - protein, 9 aa, synthetic construct
  REGION 1..9: note = Synthetic
GGAGNDTLV

SEQ ID NO: 2076 - protein, 8 aa, synthetic construct
  REGION 1..8: note = Synthetic
GGDDFEAV

SEQ ID NO: 2077 - protein, 9 aa, synthetic construct
  REGION 1..9: note = Synthetic
GKSEFTTFV

SEQ ID NO: 2078 - protein, 9 aa, synthetic construct
  REGION 1..9: note = Synthetic
GKSLFDDGL

SEQ ID NO: 2079 - protein, 9 aa, synthetic construct
  REGION 1..9: note = Synthetic
GNADNLKSV

SEQ ID NO: 2080 - protein, 9 aa, synthetic construct
  REGION 1..9: note = Synthetic
GQLVEVDTL

SEQ ID NO: 2081 - protein, 9 aa, synthetic construct
  REGION 1..9: note = Synthetic
GRSKFSPDV

SEQ ID NO: 2082 - protein, 8 aa, synthetic construct
  REGION 1..8: note = Synthetic
GSSAYDTV

SEQ ID NO: 2083 - protein, 9 aa, synthetic construct
  REGION 1..9: note = Synthetic
GTVEKWPAL

SEQ ID NO: 2084 - protein, 8 aa, synthetic construct
  REGION 1..8: note = Synthetic
GVDYYDNV

SEQ ID NO: 2085 - protein, 9 aa, synthetic construct
  REGION 1..9: note = Synthetic
GYEQFEFRV

SEQ ID NO: 2086 - protein, 9 aa, synthetic construct
  REGION 1..9: note = Synthetic
HAVGAQDVV

SEQ ID NO: 2087 - protein, 10 aa, synthetic construct
  REGION 1..10: note = Synthetic
IAAGRIGLGI

SEQ ID NO: 2088 - protein, 9 aa, synthetic construct
  REGION 1..9: note = Synthetic
IGDAQANTL

SEQ ID NO: 2089 - protein, 9 aa, synthetic construct
  REGION 1..9: note = Synthetic
IGLGILADL

SEQ ID NO: 2090 - protein, 9 aa, synthetic construct
  REGION 1..9: note = Synthetic
IGNAAGIPL

SEQ ID NO: 2091 - protein, 9 aa, synthetic construct
  REGION 1..9: note = Synthetic
IGTSMKDVL

SEQ ID NO: 2092 - protein, 9 aa, synthetic construct
  REGION 1..9: note = Synthetic
IGVITDFEL

SEQ ID NO: 2093 - protein, 9 aa, synthetic construct
  REGION 1..9: note = Synthetic
IPLTADIDM

SEQ ID NO: 2094 - protein, 8 aa, synthetic construct
  REGION 1..8: note = Synthetic
ISKSALEL

SEQ ID NO: 2095 - protein, 8 aa, synthetic construct
  REGION 1..8: note = Synthetic
ITGNADNL

SEQ ID NO: 2096 - protein, 8 aa, synthetic construct
  REGION 1..8: note = Synthetic
KIFVVSAT

SEQ ID NO: 2097 - protein, 10 aa, synthetic construct
  REGION 1..10: note = Synthetic
KQLNNANVYR

SEQ ID NO: 2098 - protein, 9 aa, synthetic construct
  REGION 1..9: note = Synthetic
KVIGNAAGI

SEQ ID NO: 2099 - protein, 8 aa, synthetic construct
  REGION 1..8: note = Synthetic
LAKVVSQL

SEQ ID NO: 2100 - protein, 9 aa, synthetic construct
  REGION 1..9: note = Synthetic
LANDYARKI

SEQ ID NO: 2101 - protein, 9 aa, synthetic construct
  REGION 1..9: note = Synthetic
LDYLRQAGL

SEQ ID NO: 2102 - protein, 8 aa, synthetic construct
  REGION 1..8: note = Synthetic
LGKGFASL

SEQ ID NO: 2103 - protein, 9 aa, synthetic construct
  REGION 1..9: note = Synthetic
LGKGFASLM

SEQ ID NO: 2104 - protein, 8 aa, synthetic construct
  REGION 1..8: note = Synthetic
LGVDYYDN

SEQ ID NO: 2105 - protein, 9 aa, synthetic construct
  REGION 1..9: note = Synthetic
LGVDYYDNV

SEQ ID NO: 2106 - protein, 10 aa, synthetic construct
  REGION 1..10: note = Synthetic
LKHSIKLDVI

SEQ ID NO: 2107 - protein, 8 aa, synthetic construct
  REGION 1..8: note = Synthetic
LQAGYIPV

SEQ ID NO: 2108 - protein, 9 aa, synthetic construct
  REGION 1..9: note = Synthetic
LQLTGGTVE

SEQ ID NO: 2109 - protein, 8 aa, synthetic construct
  REGION 1..8: note = Synthetic
LSAAVFGL

SEQ ID NO: 2110 - protein, 10 aa, synthetic construct
  REGION 1..10: note = Synthetic
LSLGKGFASL

SEQ ID NO: 2111 - protein, 9 aa, synthetic construct
  REGION 1..9: note = Synthetic
LSPMEIYGL

SEQ ID NO: 2112 - protein, 10 aa, synthetic construct
  REGION 1..10: note = Synthetic
NAHDNFLAGG

SEQ ID NO: 2113 - protein, 9 aa, synthetic construct
  REGION 1..9: note = Synthetic
NANVYREGV

SEQ ID NO: 2114 - protein, 8 aa, synthetic construct
  REGION 1..8: note = Synthetic
NDTLYGGL

SEQ ID NO: 2115 - protein, 9 aa, synthetic construct
  REGION 1..9: note = Synthetic
NGLAGNDVL

SEQ ID NO: 2116 - protein, 10 aa, synthetic construct
  REGION 1..10: note = Synthetic
NNANVYREGV

SEQ ID NO: 2117 - protein, 8 aa, synthetic construct
  REGION 1..8: note = Synthetic
NTVSYAAL

SEQ ID NO: 2118 - protein, 10 aa, synthetic construct
  REGION 1..10: note = Synthetic
NVLRNIENAV

SEQ ID NO: 2119 - protein, 9 aa, synthetic construct
  REGION 1..9: note = Synthetic
PALTFITPL

SEQ ID NO: 2120 - protein, 10 aa, synthetic construct
  REGION 1..10: note = Synthetic
PETSNVLRNI

SEQ ID NO: 2121 - protein, 8 aa, synthetic construct
  REGION 1..8: note = Synthetic
PMEIYGLV

SEQ ID NO: 2122 - protein, 9 aa, synthetic construct
  REGION 1..9: note = Synthetic
PQAYFEKNL

SEQ ID NO: 2123 - protein, 9 aa, synthetic construct
  REGION 1..9: note = Synthetic
PVNPNLSKL

SEQ ID NO: 2124 - protein, 9 aa, synthetic construct
  REGION 1..9: note = Synthetic
QAGWNASSV

SEQ ID NO: 2125 - protein, 10 aa, synthetic construct
  REGION 1..10: note = Synthetic
QAGWNASSVI

SEQ ID NO: 2126 - protein, 9 aa, synthetic construct
  REGION 1..9: note = Synthetic
QDAANAGNL

SEQ ID NO: 2127 - protein, 10 aa, synthetic construct
  REGION 1..10: note = Synthetic
QDAANAGNLL

SEQ ID NO: 2128 - protein, 8 aa, synthetic construct
  REGION 1..8: note = Synthetic
QDSGYDSL

SEQ ID NO: 2129 - protein, 9 aa, synthetic construct
  REGION 1..9: note = Synthetic
QQSHYADQL

SEQ ID NO: 2130 - protein, 9 aa, synthetic construct
  REGION 1..9: note = Synthetic
RALQGAQAV

SEQ ID NO: 2131 - protein, 9 aa, synthetic construct
  REGION 1..9: note = Synthetic
RGGLGLDTL

SEQ ID NO: 2132 - protein, 9 aa, synthetic construct
  REGION 1..9: note = Synthetic
RKQLNNANV

SEQ ID NO: 2133 - protein, 9 aa, synthetic construct
  REGION 1..9: note = Synthetic
RQDSGYDSL

SEQ ID NO: 2134 - protein, 9 aa, synthetic construct
  REGION 1..9: note = Synthetic
RQFRYDGDM

SEQ ID NO: 2135 - protein, 9 aa, synthetic construct
  REGION 1..9: note = Synthetic
RSKFSPDVL

SEQ ID NO: 2136 - protein, 9 aa, synthetic construct
  REGION 1..9: note = Synthetic
SAGAAAGAL

SEQ ID NO: 2137 - protein, 9 aa, synthetic construct
  REGION 1..9: note = Synthetic
SAHWGQRAL

SEQ ID NO: 2138 - protein, 9 aa, synthetic construct
  REGION 1..9: note = Synthetic
SAMIHPGRI

SEQ ID NO: 2139 - protein, 10 aa, synthetic construct
  REGION 1..10: note = Synthetic
SAMIHPGRIV

SEQ ID NO: 2140 - protein, 9 aa, synthetic construct
  REGION 1..9: note = Synthetic
SAYDTVSGI

SEQ ID NO: 2141 - protein, 8 aa, synthetic construct
  REGION 1..8: note = Synthetic
SAYGYEGD

SEQ ID NO: 2142 - protein, 9 aa, synthetic construct
  REGION 1..9: note = Synthetic
SGGAGDDVL

SEQ ID NO: 2143 - protein, 8 aa, synthetic construct
  REGION 1..8: note = Synthetic
SGLQVAGA

SEQ ID NO: 2144 - protein, 9 aa, synthetic construct
  REGION 1..9: note = Synthetic
SGYDSLDGV

SEQ ID NO: 2145 - protein, 10 aa, synthetic construct
  REGION 1..10: note = Synthetic
SLLTGALNGI

SEQ ID NO: 2146 - protein, 8 aa, synthetic construct
  REGION 1..8: note = Synthetic
SPMEIYGL

SEQ ID NO: 2147 - protein, 9 aa, synthetic construct
  REGION 1..9: note = Synthetic
SQMLTRGQL

SEQ ID NO: 2148 - protein, 10 aa, synthetic construct
  REGION 1..10: note = Synthetic
SSAYDTVSGI

SEQ ID NO: 2149 - protein, 9 aa, synthetic construct
  REGION 1..9: note = Synthetic
SSLAHGHTA

SEQ ID NO: 2150 - protein, 9 aa, synthetic construct
  REGION 1..9: note = Synthetic
SSVTSGDSV

SEQ ID NO: 2151 - protein, 10 aa, synthetic construct
  REGION 1..10: note = Synthetic
SVIGVQTTEI

SEQ ID NO: 2152 - protein, 9 aa, synthetic construct
  REGION 1..9: note = Synthetic
TNTVSYAAL

SEQ ID NO: 2153 - protein, 8 aa, synthetic construct
  REGION 1..8: note = Synthetic
TSLIAEGV

SEQ ID NO: 2154 - protein, 8 aa, synthetic construct
  REGION 1..8: note = Synthetic
TSLLTGAL

SEQ ID NO: 2155 - protein, 8 aa, synthetic construct
  REGION 1..8: note = Synthetic
TVPASPGL

SEQ ID NO: 2156 - protein, 9 aa, synthetic construct
  REGION 1..9: note = Synthetic
VAKEKNATL

SEQ ID NO: 2157 - protein, 10 aa, synthetic construct
  REGION 1..10: note = Synthetic
VAPHEYGFGI

SEQ ID NO: 2158 - protein, 8 aa, synthetic construct
  REGION 1..8: note = Synthetic
VAVVTSLL

SEQ ID NO: 2159 - protein, 9 aa, synthetic construct
  REGION 1..9: note = Synthetic
VFYENRAYG

SEQ ID NO: 2160 - protein, 10 aa, synthetic construct
  REGION 1..10: note = Synthetic
VFYENRAYGV

SEQ ID NO: 2161 - protein, 9 aa, synthetic construct
  REGION 1..9: note = Synthetic
VITDFELEV

SEQ ID NO: 2162 - protein, 8 aa, synthetic construct
  REGION 1..8: note = Synthetic
VNPHSTSL

SEQ ID NO: 2163 - protein, 9 aa, synthetic construct
  REGION 1..9: note = Synthetic
VNPHSTSLI

SEQ ID NO: 2164 - protein, 8 aa, synthetic construct
  REGION 1..8: note = Synthetic
VNPNLSKL

SEQ ID NO: 2165 - protein, 9 aa, synthetic construct
  REGION 1..9: note = Synthetic
VNPNLSKLF

SEQ ID NO: 2166 - protein, 9 aa, synthetic construct
  REGION 1..9: note = Synthetic
VQQPIIEKL

SEQ ID NO: 2167 - protein, 8 aa, synthetic construct
  REGION 1..8: note = Synthetic
VQYRHVEL

SEQ ID NO: 2168 - protein, 9 aa, synthetic construct
  REGION 1..9: note = Synthetic
VSIAAAASV

SEQ ID NO: 2169 - protein, 10 aa, synthetic construct
  REGION 1..10: note = Synthetic
VSIAAAASVV

SEQ ID NO: 2170 - protein, 9 aa, synthetic construct
  REGION 1..9: note = Synthetic
VTSLLTGAL

SEQ ID NO: 2171 - protein, 9 aa, synthetic construct
  REGION 1..9: note = Synthetic
VVLANASRI

SEQ ID NO: 2172 - protein, 9 aa, synthetic construct
  REGION 1..9: note = Synthetic
WPALNLFSV

SEQ ID NO: 2173 - protein, 8 aa, synthetic construct
  REGION 1..8: note = Synthetic
WVRKASAL

SEQ ID NO: 2174 - protein, 10 aa, synthetic construct
  REGION 1..10: note = Synthetic
YAVQYRRKGG

SEQ ID NO: 2175 - protein, 9 aa, synthetic construct
  REGION 1..9: note = Synthetic
YGGLGDDTL

SEQ ID NO: 2176 - protein, 10 aa, synthetic construct
  REGION 1..10: note = Synthetic
YGLVQQSHYA

SEQ ID NO: 2177 - protein, 9 aa, synthetic construct
  REGION 1..9: note = Synthetic
YGYEGDALL

SEQ ID NO: 2178 - protein, 8 aa, synthetic construct
  REGION 1..8: note = Synthetic
YIPVNPNL

SEQ ID NO: 2179 - protein, 10 aa, synthetic construct
  REGION 1..10: note = Synthetic
YSAMIHPGRI

SEQ ID NO: 2180 - protein, 10 aa, synthetic construct
  REGION 1..10: note = Synthetic
YSQTGAHAGI

SEQ ID NO: 2181 - protein, 20 aa, synthetic construct
  REGION 1..20: note = Synthetic
AYNFVESIINLFQVVHNSYN

SEQ ID NO: 2182 - protein, 6 aa, synthetic construct
  REGION 1..6: note = Synthetic
SGTTIK

SEQ ID NO: 2183 - protein, 15 aa, synthetic construct
  REGION 1..15: note = Synthetic
RGHTLESAEGRKIFG

SEQ ID NO: 2184 - protein, 22 aa, synthetic construct
  REGION 1..22: note = Synthetic
AGAMTVRDVAAAADLALQAGDA

SEQ ID NO: 2185 - protein, 23 aa, synthetic construct
  REGION 1..23: note = Synthetic
AGAMTVRDVAAAADLALQAGDAL

SEQ ID NO: 2186 - protein, 30 aa, synthetic construct
  REGION 1..30: note = Synthetic
ALAAVLVNPHIFTRIGAAQTSLADGAAGPA

SEQ ID NO: 2187 - protein, 12 aa, synthetic construct
  REGION 1..12: note = Synthetic
ALSIDSMTALGA

SEQ ID NO: 2188 - protein, 15 aa, synthetic construct
  REGION 1..15: note = Synthetic
DLSAARGADISGEGR

SEQ ID NO: 2189 - protein, 12 aa, synthetic construct
  REGION 1..12: note = Synthetic
DQNRYEYIWGLY

SEQ ID NO: 2190 - protein, 12 aa, synthetic construct
  REGION 1..12: note = Synthetic
DYTVSADAIALA

SEQ ID NO: 2191 - protein, 16 aa, synthetic construct
  REGION 1..16: note = Synthetic
GPIVVEAGELVSHAGG

SEQ ID NO: 2192 - protein, 23 aa, synthetic construct
  REGION 1..23: note = Synthetic
GRPEGLKIGAHSATSVSGSFDAL

SEQ ID NO: 2193 - protein, 19 aa, synthetic construct
  REGION 1..19: note = Synthetic
ITVTSRGGFDNEGKMESNK

SEQ ID NO: 2194 - protein, 14 aa, synthetic construct
  REGION 1..14: note = Synthetic
LDQNRYEYIWGLYP

SEQ ID NO: 2195 - protein, 11 aa, synthetic construct
  REGION 1..11: note = Synthetic
LSAARGADISG

SEQ ID NO: 2196 - protein, 10 aa, synthetic construct
  REGION 1..10: note = Synthetic
NKIRLMGPLQ

SEQ ID NO: 2197 - protein, 12 aa, synthetic construct
  REGION 1..12: note = Synthetic
NKLGRIRAGEDM

SEQ ID NO: 2198 - protein, 20 aa, synthetic construct
  REGION 1..20: note = Synthetic
NKLGRIRAGEDMHLDAPRIE

SEQ ID NO: 2199 - protein, 12 aa, synthetic construct
  REGION 1..12: note = Synthetic
PHLRNTGQVVAG

SEQ ID NO: 2200 - protein, 17 aa, synthetic construct
  REGION 1..17: note = Synthetic
QVDLHDLSAARGADISG

SEQ ID NO: 2201 - protein, 12 aa, synthetic construct
  REGION 1..12: note = Synthetic
RDVAAAADLALQ

SEQ ID NO: 2202 - protein, 12 aa, synthetic construct
  REGION 1..12: note = Synthetic
SAARGADISGEG

SEQ ID NO: 2203 - protein, 15 aa, synthetic construct
  REGION 1..15: note = Synthetic
TKGEMQIAGKGGGSP

SEQ ID NO: 2204 - protein, 12 aa, synthetic construct
  REGION 1..12: note = Synthetic
TVSADAIALAAQ

SEQ ID NO: 2205 - protein, 9 aa, synthetic construct
  REGION 1..9: note = Synthetic
VVAGHDIHI

SEQ ID NO: 2206 - protein, 24 aa, synthetic construct
  REGION 1..24: note = Synthetic
PSGPNHTKVVQLPKISKNALKANG

SEQ ID NO: 2207 - protein, 41 aa, synthetic construct
  REGION 1..41: note = Synthetic
LVGATPERPRLRLVDADDPLLRTAPGPGEVWVTPVIGSQAR

SEQ ID NO: 2208 - protein, 27 aa, synthetic construct
  REGION 1..27: note = Synthetic
QQSRWGLGSPNCHGPDWASPVCQRHSP

SEQ ID NO: 2209 - protein, 17 aa, synthetic construct
  REGION 1..17: note = Synthetic
AGEAMVLVYYESIAYSF

SEQ ID NO: 2210 - protein, 24 aa, synthetic construct
  REGION 1..24: note = Synthetic
GGVGLASTLWYAESNALSKRLGEL

SEQ ID NO: 2211 - protein, 18 aa, synthetic construct
  REGION 1..18: note = Synthetic
GTLVRIAPVIGACMARQA

SEQ ID NO: 2212 - protein, 18 aa, synthetic construct
  REGION 1..18: note = Synthetic
IRRVTRVYHNGITGETTT

SEQ ID NO: 2213 - protein, 18 aa, synthetic construct
  REGION 1..18: note = Synthetic
IVKTGERQHGIHIQGSDP

SEQ ID NO: 2214 - protein, 24 aa, synthetic construct
  REGION 1..24: note = Synthetic
IVKTGERQHGIHIQGSDPGGVRTA

SEQ ID NO: 2215 - protein, 24 aa, synthetic construct
  REGION 1..24: note = Synthetic
LRDTNVTAVPASGAPAAVSVLGAS

SEQ ID NO: 2216 - protein, 24 aa, synthetic construct
  REGION 1..24: note = Synthetic
PEAPAPQPPAGRELSAAANAAVNT

SEQ ID NO: 2217 - protein, 9 aa, synthetic construct
  REGION 1..9: note = Synthetic
AAADFAHAE

SEQ ID NO: 2218 - protein, 9 aa, synthetic construct
  REGION 1..9: note = Synthetic
AAAEVAGAL

SEQ ID NO: 2219 - protein, 9 aa, synthetic construct
  REGION 1..9: note = Synthetic
AAESTFESY

SEQ ID NO: 2220 - protein, 9 aa, synthetic construct
  REGION 1..9: note = Synthetic
AAGFDPEVQ

SEQ ID NO: 2221 - protein, 9 aa, synthetic construct
  REGION 1..9: note = Synthetic
AALGRGHSL

SEQ ID NO: 2222 - protein, 9 aa, synthetic construct
  REGION 1..9: note = Synthetic
AAMQGAVVH

SEQ ID NO: 2223 - protein, 9 aa, synthetic construct
  REGION 1..9: note = Synthetic
AAPAAHADW

SEQ ID NO: 2224 - protein, 9 aa, synthetic construct
  REGION 1..9: note = Synthetic
AAQATVVQR

SEQ ID NO: 2225 - protein, 9 aa, synthetic construct
  REGION 1..9: note = Synthetic
AARVAGDNY

SEQ ID NO: 2226 - protein, 9 aa, synthetic construct
  REGION 1..9: note = Synthetic
AAVALLNKL

SEQ ID NO: 2227 - protein, 9 aa, synthetic construct
  REGION 1..9: note = Synthetic
ADDPPATVY

SEQ ID NO: 2228 - protein, 9 aa, synthetic construct
  REGION 1..9: note = Synthetic
AEAGRFKVL

SEQ ID NO: 2229 - protein, 9 aa, synthetic construct
  REGION 1..9: note = Synthetic
AEATQLVTA

SEQ ID NO: 2230 - protein, 9 aa, synthetic construct
  REGION 1..9: note = Synthetic
AEGGATLGA

SEQ ID NO: 2231 - protein, 9 aa, synthetic construct
  REGION 1..9: note = Synthetic
AEHGEVSIQ

SEQ ID NO: 2232 - protein, 9 aa, synthetic construct
  REGION 1..9: note = Synthetic
AEIAFYPKE

SEQ ID NO: 2233 - protein, 9 aa, synthetic construct
  REGION 1..9: note = Synthetic
AEKVTTPAV

SEQ ID NO: 2234 - protein, 9 aa, synthetic construct
  REGION 1..9: note = Synthetic
AELQTYLRQ

SEQ ID NO: 2235 - protein, 9 aa, synthetic construct
  REGION 1..9: note = Synthetic
AEQSLIEVG

SEQ ID NO: 2236 - protein, 9 aa, synthetic construct
  REGION 1..9: note = Synthetic
AESNALSKR

SEQ ID NO: 2237 - protein, 9 aa, synthetic construct
  REGION 1..9: note = Synthetic
AESSEAMAA

SEQ ID NO: 2238 - protein, 9 aa, synthetic construct
  REGION 1..9: note = Synthetic
AEVKVGYRA

SEQ ID NO: 2239 - protein, 9 aa, synthetic construct
  REGION 1..9: note = Synthetic
AEVTDTSPS

SEQ ID NO: 2240 - protein, 9 aa, synthetic construct
  REGION 1..9: note = Synthetic
AGKSLKKKN

SEQ ID NO: 2241 - protein, 9 aa, synthetic construct
  REGION 1..9: note = Synthetic
AGLAGPSAV

SEQ ID NO: 2242 - protein, 9 aa, synthetic construct
  REGION 1..9: note = Synthetic
AIRVGRGAR

SEQ ID NO: 2243 - protein, 9 aa, synthetic construct
  REGION 1..9: note = Synthetic
ALAAIASAA

SEQ ID NO: 2244 - protein, 9 aa, synthetic construct
  REGION 1..9: note = Synthetic
ALADVPYVL

SEQ ID NO: 2245 - protein, 9 aa, synthetic construct
  REGION 1..9: note = Synthetic
ALANDGTIV

SEQ ID NO: 2246 - protein, 9 aa, synthetic construct
  REGION 1..9: note = Synthetic
ALGRGHSLY

SEQ ID NO: 2247 - protein, 9 aa, synthetic construct
  REGION 1..9: note = Synthetic
ALILAASPV

SEQ ID NO: 2248 - protein, 9 aa, synthetic construct
  REGION 1..9: note = Synthetic
ALMLACTGL

SEQ ID NO: 2249 - protein, 9 aa, synthetic construct
  REGION 1..9: note = Synthetic
AMQGAVVHL

SEQ ID NO: 2250 - protein, 9 aa, synthetic construct
  REGION 1..9: note = Synthetic
AMTHLSPAL

SEQ ID NO: 2251 - protein, 9 aa, synthetic construct
  REGION 1..9: note = Synthetic
AMYGKHITL

SEQ ID NO: 2252 - protein, 9 aa, synthetic construct
  REGION 1..9: note = Synthetic
ANEANALLW

SEQ ID NO: 2253 - protein, 9 aa, synthetic construct
  REGION 1..9: note = Synthetic
APLSITLQA

SEQ ID NO: 2254 - protein, 9 aa, synthetic construct
  REGION 1..9: note = Synthetic
APNALAWAL

SEQ ID NO: 2255 - protein, 9 aa, synthetic construct
  REGION 1..9: note = Synthetic
APPAPKPAP

SEQ ID NO: 2256 - protein, 9 aa, synthetic construct
  REGION 1..9: note = Synthetic
APPGAGFIY

SEQ ID NO: 2257 - protein, 9 aa, synthetic construct
  REGION 1..9: note = Synthetic
APQAAPLSI

SEQ ID NO: 2258 - protein, 9 aa, synthetic construct
  REGION 1..9: note = Synthetic
APRIENTAK

SEQ ID NO: 2259 - protein, 9 aa, synthetic construct
  REGION 1..9: note = Synthetic
AQGKALLYR

SEQ ID NO: 2260 - protein, 9 aa, synthetic construct
  REGION 1..9: note = Synthetic
AQITSYVGF

SEQ ID NO: 2261 - protein, 9 aa, synthetic construct
  REGION 1..9: note = Synthetic
AQLEVRGQR

SEQ ID NO: 2262 - protein, 9 aa, synthetic construct
  REGION 1..9: note = Synthetic
AQQLKQADR

SEQ ID NO: 2263 - protein, 9 aa, synthetic construct
  REGION 1..9: note = Synthetic
AQVTVAGRY

SEQ ID NO: 2264 - protein, 9 aa, synthetic construct
  REGION 1..9: note = Synthetic
ARRSRVRAL

SEQ ID NO: 2265 - protein, 9 aa, synthetic construct
  REGION 1..9: note = Synthetic
ASPRRARRA

SEQ ID NO: 2266 - protein, 9 aa, synthetic construct
  REGION 1..9: note = Synthetic
ASSPDAHVP

SEQ ID NO: 2267 - protein, 9 aa, synthetic construct
  REGION 1..9: note = Synthetic
ASVSNPGTF

SEQ ID NO: 2268 - protein, 9 aa, synthetic construct
  REGION 1..9: note = Synthetic
ATWNFQSTY

SEQ ID NO: 2269 - protein, 9 aa, synthetic construct
  REGION 1..9: note = Synthetic
ATYIADSGF

SEQ ID NO: 2270 - protein, 9 aa, synthetic construct
  REGION 1..9: note = Synthetic
AVAAPAVGA

SEQ ID NO: 2271 - protein, 9 aa, synthetic construct
  REGION 1..9: note = Synthetic
AVFMQQRPL

SEQ ID NO: 2272 - protein, 9 aa, synthetic construct
  REGION 1..9: note = Synthetic
AVLVNPHIF

SEQ ID NO: 2273 - protein, 9 aa, synthetic construct
  REGION 1..9: note = Synthetic
CFGKDLKRP

SEQ ID NO: 2274 - protein, 9 aa, synthetic construct
  REGION 1..9: note = Synthetic
CPSSLGNGV

SEQ ID NO: 2275 - protein, 9 aa, synthetic construct
  REGION 1..9: note = Synthetic
DAGHEHDTW

SEQ ID NO: 2276 - protein, 9 aa, synthetic construct
  REGION 1..9: note = Synthetic
DAKHDLTVT

SEQ ID NO: 2277 - protein, 9 aa, synthetic construct
  REGION 1..9: note = Synthetic
DASGQHRLW

SEQ ID NO: 2278 - protein, 9 aa, synthetic construct
  REGION 1..9: note = Synthetic
DATFETYAL

SEQ ID NO: 2279 - protein, 9 aa, synthetic construct
  REGION 1..9: note = Synthetic
DATFQTYAL

SEQ ID NO: 2280 - protein, 9 aa, synthetic construct
  REGION 1..9: note = Synthetic
DATLVGAKF

SEQ ID NO: 2281 - protein, 9 aa, synthetic construct
  REGION 1..9: note = Synthetic
DDEVDVSGR

SEQ ID NO: 2282 - protein, 9 aa, synthetic construct
  REGION 1..9: note = Synthetic
DENGKPQTY

SEQ ID NO: 2283 - protein, 9 aa, synthetic construct
  REGION 1..9: note = Synthetic
DGPPSRPTT

SEQ ID NO: 2284 - protein, 9 aa, synthetic construct
  REGION 1..9: note = Synthetic
DHLTGRSCQ

SEQ ID NO: 2285 - protein, 9 aa, synthetic construct
  REGION 1..9: note = Synthetic
DNEGKMESN

SEQ ID NO: 2286 - protein, 9 aa, synthetic construct
  REGION 1..9: note = Synthetic
DPPATVYRY

SEQ ID NO: 2287 - protein, 9 aa, synthetic construct
  REGION 1..9: note = Synthetic
EATEGDATL

SEQ ID NO: 2288 - protein, 9 aa, synthetic construct
  REGION 1..9: note = Synthetic
EATQQAAGF

SEQ ID NO: 2289 - protein, 9 aa, synthetic construct
  REGION 1..9: note = Synthetic
ECSGKQDCP

SEQ ID NO: 2290 - protein, 9 aa, synthetic construct
  REGION 1..9: note = Synthetic
EGGKLRGKD

SEQ ID NO: 2291 - protein, 9 aa, synthetic construct
  REGION 1..9: note = Synthetic
EGKMESNKD

SEQ ID NO: 2292 - protein, 9 aa, synthetic construct
  REGION 1..9: note = Synthetic
EHRMQEAVE

SEQ ID NO: 2293 - protein, 9 aa, synthetic construct
  REGION 1..9: note = Synthetic
EKRLDIDDA

SEQ ID NO: 2294 - protein, 9 aa, synthetic construct
  REGION 1..9: note = Synthetic
EPASANTLL

SEQ ID NO: 2295 - protein, 9 aa, synthetic construct
  REGION 1..9: note = Synthetic
EPQAELAVF

SEQ ID NO: 2296 - protein, 9 aa, synthetic construct
  REGION 1..9: note = Synthetic
EPVKLTLTG

SEQ ID NO: 2297 - protein, 9 aa, synthetic construct
  REGION 1..9: note = Synthetic
ESAEGRKIF

SEQ ID NO: 2298 - protein, 9 aa, synthetic construct
  REGION 1..9: note = Synthetic
ESYSESHNF

SEQ ID NO: 2299 - protein, 9 aa, synthetic construct
  REGION 1..9: note = Synthetic
ETFCITTIY

SEQ ID NO: 2300 - protein, 9 aa, synthetic construct
  REGION 1..9: note = Synthetic
EVAGALELS

SEQ ID NO: 2301 - protein, 9 aa, synthetic construct
  REGION 1..9: note = Synthetic
EVAKVEVVP

SEQ ID NO: 2302 - protein, 9 aa, synthetic construct
  REGION 1..9: note = Synthetic
EVDGIIQEF

SEQ ID NO: 2303 - protein, 9 aa, synthetic construct
  REGION 1..9: note = Synthetic
EVRADNNFY

SEQ ID NO: 2304 - protein, 9 aa, synthetic construct
  REGION 1..9: note = Synthetic
FAILSSTTE

SEQ ID NO: 2305 - protein, 9 aa, synthetic construct
  REGION 1..9: note = Synthetic
FAISAYALK

SEQ ID NO: 2306 - protein, 9 aa, synthetic construct
  REGION 1..9: note = Synthetic
FALYDGTYL

SEQ ID NO: 2307 - protein, 9 aa, synthetic construct
  REGION 1..9: note = Synthetic
FDTMLGFAI

SEQ ID NO: 2308 - protein, 9 aa, synthetic construct
  REGION 1..9: note = Synthetic
FEGKPALEL

SEQ ID NO: 2309 - protein, 9 aa, synthetic construct
  REGION 1..9: note = Synthetic
FELGADHAV

SEQ ID NO: 2310 - protein, 9 aa, synthetic construct
  REGION 1..9: note = Synthetic
FEPGITTNY

SEQ ID NO: 2311 - protein, 9 aa, synthetic construct
  REGION 1..9: note = Synthetic
FETYALTGI

SEQ ID NO: 2312 - protein, 9 aa, synthetic construct
  REGION 1..9: note = Synthetic
FIYRETFCI

SEQ ID NO: 2313 - protein, 9 aa, synthetic construct
  REGION 1..9: note = Synthetic
FPTRTTAPG

SEQ ID NO: 2314 - protein, 9 aa, synthetic construct
  REGION 1..9: note = Synthetic
FQTYALTGI

SEQ ID NO: 2315 - protein, 9 aa, synthetic construct
  REGION 1..9: note = Synthetic
FTHADGWFL

SEQ ID NO: 2316 - protein, 9 aa, synthetic construct
  REGION 1..9: note = Synthetic
FVRDGQSVI

SEQ ID NO: 2317 - protein, 9 aa, synthetic construct
  REGION 1..9: note = Synthetic
FVRSGQPVI

SEQ ID NO: 2318 - protein, 9 aa, synthetic construct
  REGION 1..9: note = Synthetic
FVWYVDTVI

SEQ ID NO: 2319 - protein, 9 aa, synthetic construct
  REGION 1..9: note = Synthetic
GAASSRQAL

SEQ ID NO: 2320 - protein, 9 aa, synthetic construct
  REGION 1..9: note = Synthetic
GAASSYFEY

SEQ ID NO: 2321 - protein, 9 aa, synthetic construct
  REGION 1..9: note = Synthetic
GAFDLKTTF

SEQ ID NO: 2322 - protein, 9 aa, synthetic construct
  REGION 1..9: note = Synthetic
GAPAAVSVL

SEQ ID NO: 2323 - protein, 9 aa, synthetic construct
  REGION 1..9: note = Synthetic
GATRAVDSL

SEQ ID NO: 2324 - protein, 9 aa, synthetic construct
  REGION 1..9: note = Synthetic
GAVPGGAVP

SEQ ID NO: 2325 - protein, 9 aa, synthetic construct
  REGION 1..9: note = Synthetic
GEAMVLVYY

SEQ ID NO: 2326 - protein, 9 aa, synthetic construct
  REGION 1..9: note = Synthetic
GEIALGDAT

SEQ ID NO: 2327 - protein, 9 aa, synthetic construct
  REGION 1..9: note = Synthetic
GELMAAQVA

SEQ ID NO: 2328 - protein, 9 aa, synthetic construct
  REGION 1..9: note = Synthetic
GGVPGGAVP

SEQ ID NO: 2329 - protein, 9 aa, synthetic construct
  REGION 1..9: note = Synthetic
GHEHDTWFD

SEQ ID NO: 2330 - protein, 9 aa, synthetic construct
  REGION 1..9: note = Synthetic
GIGALKAGA

SEQ ID NO: 2331 - protein, 9 aa, synthetic construct
  REGION 1..9: note = Synthetic
GIVIPPKAL

SEQ ID NO: 2332 - protein, 9 aa, synthetic construct
  REGION 1..9: note = Synthetic
GKDLKRPGS

SEQ ID NO: 2333 - protein, 9 aa, synthetic construct
  REGION 1..9: note = Synthetic
GKLPKPVTV

SEQ ID NO: 2334 - protein, 9 aa, synthetic construct
  REGION 1..9: note = Synthetic
GKSLKKKNQ

SEQ ID NO: 2335 - protein, 9 aa, synthetic construct
  REGION 1..9: note = Synthetic
GLDVQQGTV

SEQ ID NO: 2336 - protein, 9 aa, synthetic construct
  REGION 1..9: note = Synthetic
GLTDGVSRI

SEQ ID NO: 2337 - protein, 9 aa, synthetic construct
  REGION 1..9: note = Synthetic
GLYPTYTEW

SEQ ID NO: 2338 - protein, 9 aa, synthetic construct
  REGION 1..9: note = Synthetic
GLYQTYTEW

SEQ ID NO: 2339 - protein, 9 aa, synthetic construct
  REGION 1..9: note = Synthetic
GPPSRPTTP

SEQ ID NO: 2340 - protein, 9 aa, synthetic construct
  REGION 1..9: note = Synthetic
GPSAVAAPA

SEQ ID NO: 2341 - protein, 9 aa, synthetic construct
  REGION 1..9: note = Synthetic
GVAPTAQQL

SEQ ID NO: 2342 - protein, 9 aa, synthetic construct
  REGION 1..9: note = Synthetic
GVGLASTLW

SEQ ID NO: 2343 - protein, 9 aa, synthetic construct
  REGION 1..9: note = Synthetic
GYEAGFSLG

SEQ ID NO: 2344 - protein, 9 aa, synthetic construct
  REGION 1..9: note = Synthetic
HADDGTIVI

SEQ ID NO: 2345 - protein, 9 aa, synthetic construct
  REGION 1..9: note = Synthetic
HADWNNQSI

SEQ ID NO: 2346 - protein, 9 aa, synthetic construct
  REGION 1..9: note = Synthetic
HAEHEKDVR

SEQ ID NO: 2347 - protein, 9 aa, synthetic construct
  REGION 1..9: note = Synthetic
HANHYGTRI

SEQ ID NO: 2348 - protein, 9 aa, synthetic construct
  REGION 1..9: note = Synthetic
HAQGKALLY

SEQ ID NO: 2349 - protein, 9 aa, synthetic construct
  REGION 1..9: note = Synthetic
HFIGYIYEV

SEQ ID NO: 2350 - protein, 9 aa, synthetic construct
  REGION 1..9: note = Synthetic
HLSPALADV

SEQ ID NO: 2351 - protein, 9 aa, synthetic construct
  REGION 1..9: note = Synthetic
HSLYASYEY

SEQ ID NO: 2352 - protein, 9 aa, synthetic construct
  REGION 1..9: note = Synthetic
HVRGMLVPV

SEQ ID NO: 2353 - protein, 9 aa, synthetic construct
  REGION 1..9: note = Synthetic
HVSKEEQYY

SEQ ID NO: 2354 - protein, 9 aa, synthetic construct
  REGION 1..9: note = Synthetic
HVTRGWSIF

SEQ ID NO: 2355 - protein, 9 aa, synthetic construct
  REGION 1..9: note = Synthetic
IADSGFYLD

SEQ ID NO: 2356 - protein, 9 aa, synthetic construct
  REGION 1..9: note = Synthetic
IAHRTELRG

SEQ ID NO: 2357 - protein, 9 aa, synthetic construct
  REGION 1..9: note = Synthetic
IENTAKLSG

SEQ ID NO: 2358 - protein, 9 aa, synthetic construct
  REGION 1..9: note = Synthetic
IESKISQSV

SEQ ID NO: 2359 - protein, 9 aa, synthetic construct
  REGION 1..9: note = Synthetic
IETGGARRF

SEQ ID NO: 2360 - protein, 9 aa, synthetic construct
  REGION 1..9: note = Synthetic
IIKDAPPGA

SEQ ID NO: 2361 - protein, 9 aa, synthetic construct
  REGION 1..9: note = Synthetic
IIQEFAADL

SEQ ID NO: 2362 - protein, 9 aa, synthetic construct
  REGION 1..9: note = Synthetic
ILAGALATY

SEQ ID NO: 2363 - protein, 9 aa, synthetic construct
  REGION 1..9: note = Synthetic
ILLENPAAE

SEQ ID NO: 2364 - protein, 9 aa, synthetic construct
  REGION 1..9: note = Synthetic
ILPILVLAL

SEQ ID NO: 2365 - protein, 9 aa, synthetic construct
  REGION 1..9: note = Synthetic
IPFQRALRL

SEQ ID NO: 2366 - protein, 9 aa, synthetic construct
  REGION 1..9: note = Synthetic
ISVRVHVSK

SEQ ID NO: 2367 - protein, 9 aa, synthetic construct
  REGION 1..9: note = Synthetic
ITNETGKTY

SEQ ID NO: 2368 - protein, 9 aa, synthetic construct
  REGION 1..9: note = Synthetic
ITNKRAALI

SEQ ID NO: 2369 - protein, 9 aa, synthetic construct
  REGION 1..9: note = Synthetic
ITSYVGFSV

SEQ ID NO: 2370 - protein, 9 aa, synthetic construct
  REGION 1..9: note = Synthetic
ITVTSRGGF

SEQ ID NO: 2371 - protein, 9 aa, synthetic construct
  REGION 1..9: note = Synthetic
IVIPPKALF

SEQ ID NO: 2372 - protein, 9 aa, synthetic construct
  REGION 1..9: note = Synthetic
IVVEAGELV

SEQ ID NO: 2373 - protein, 9 aa, synthetic construct
  REGION 1..9: note = Synthetic
KAAKSVNLM

SEQ ID NO: 2374 - protein, 9 aa, synthetic construct
  REGION 1..9: note = Synthetic
KAAPLRRTT

SEQ ID NO: 2375 - protein, 9 aa, synthetic construct
  REGION 1..9: note = Synthetic
KAGKLSATG

SEQ ID NO: 2376 - protein, 9 aa, synthetic construct
  REGION 1..9: note = Synthetic
KAGTIAAPW

SEQ ID NO: 2377 - protein, 9 aa, synthetic construct
  REGION 1..9: note = Synthetic
KAKSLTTEI

SEQ ID NO: 2378 - protein, 9 aa, synthetic construct
  REGION 1..9: note = Synthetic
KATVTTVQV

SEQ ID NO: 2379 - protein, 9 aa, synthetic construct
  REGION 1..9: note = Synthetic
KDYRDKDGG

SEQ ID NO: 2380 - protein, 9 aa, synthetic construct
  REGION 1..9: note = Synthetic
KEAATIVAA

SEQ ID NO: 2381 - protein, 9 aa, synthetic construct
  REGION 1..9: note = Synthetic
KEDVDAAQI

SEQ ID NO: 2382 - protein, 9 aa, synthetic construct
  REGION 1..9: note = Synthetic
KEVDGIIQE

SEQ ID NO: 2383 - protein, 9 aa, synthetic construct
  REGION 1..9: note = Synthetic
KGPKLAMPW

SEQ ID NO: 2384 - protein, 9 aa, synthetic construct
  REGION 1..9: note = Synthetic
KLASGGGAV

SEQ ID NO: 2385 - protein, 9 aa, synthetic construct
  REGION 1..9: note = Synthetic
KLKGKNQEF

SEQ ID NO: 2386 - protein, 9 aa, synthetic construct
  REGION 1..9: note = Synthetic
KLLHHILPI

SEQ ID NO: 2387 - protein, 9 aa, synthetic construct
  REGION 1..9: note = Synthetic
KPAPQPGPQ

SEQ ID NO: 2388 - protein, 9 aa, synthetic construct
  REGION 1..9: note = Synthetic
KPAPTAPPM

SEQ ID NO: 2389 - protein, 9 aa, synthetic construct
  REGION 1..9: note = Synthetic
KPAVSVKVA

SEQ ID NO: 2390 - protein, 9 aa, synthetic construct
  REGION 1..9: note = Synthetic
KPDRAARVA

SEQ ID NO: 2391 - protein, 9 aa, synthetic construct
  REGION 1..9: note = Synthetic
KPLADIAVI

SEQ ID NO: 2392 - protein, 9 aa, synthetic construct
  REGION 1..9: note = Synthetic
KPLADIAVV

SEQ ID NO: 2393 - protein, 9 aa, synthetic construct
  REGION 1..9: note = Synthetic
KPLPKPLPV

SEQ ID NO: 2394 - protein, 9 aa, synthetic construct
  REGION 1..9: note = Synthetic
KQADRDFVW

SEQ ID NO: 2395 - protein, 9 aa, synthetic construct
  REGION 1..9: note = Synthetic
KSLPGGKLP

SEQ ID NO: 2396 - protein, 9 aa, synthetic construct
  REGION 1..9: note = Synthetic
KSYTLRYLA

SEQ ID NO: 2397 - protein, 9 aa, synthetic construct
  REGION 1..9: note = Synthetic
KTNMVVTSV

SEQ ID NO: 2398 - protein, 9 aa, synthetic construct
  REGION 1..9: note = Synthetic
KVLAPRLYL

SEQ ID NO: 2399 - protein, 9 aa, synthetic construct
  REGION 1..9: note = Synthetic
KVLSTKTTL

SEQ ID NO: 2400 - protein, 9 aa, synthetic construct
  REGION 1..9: note = Synthetic
LAAGAGLTL

SEQ ID NO: 2401 - protein, 9 aa, synthetic construct
  REGION 1..9: note = Synthetic
LAAIASAAH

SEQ ID NO: 2402 - protein, 9 aa, synthetic construct
  REGION 1..9: note = Synthetic
LAANGNGQW

SEQ ID NO: 2403 - protein, 9 aa, synthetic construct
  REGION 1..9: note = Synthetic
LAAQVTQRG

SEQ ID NO: 2404 - protein, 9 aa, synthetic construct
  REGION 1..9: note = Synthetic
LAARGDGAL

SEQ ID NO: 2405 - protein, 9 aa, synthetic construct
  REGION 1..9: note = Synthetic
LAAVLVNPH

SEQ ID NO: 2406 - protein, 9 aa, synthetic construct
  REGION 1..9: note = Synthetic
LAGSGLFRM

SEQ ID NO: 2407 - protein, 9 aa, synthetic construct
  REGION 1..9: note = Synthetic
LAKALSAAL

SEQ ID NO: 2408 - protein, 9 aa, synthetic construct
  REGION 1..9: note = Synthetic
LALQAGDAL

SEQ ID NO: 2409 - protein, 9 aa, synthetic construct
  REGION 1..9: note = Synthetic
LAMPWTFHA

SEQ ID NO: 2410 - protein, 9 aa, synthetic construct
  REGION 1..9: note = Synthetic
LANDGTIVI

SEQ ID NO: 2411 - protein, 9 aa, synthetic construct
  REGION 1..9: note = Synthetic
LAPTVGVAF

SEQ ID NO: 2412 - protein, 9 aa, synthetic construct
  REGION 1..9: note = Synthetic
LASDGSVDF

SEQ ID NO: 2413 - protein, 9 aa, synthetic construct
  REGION 1..9: note = Synthetic
LATYQSEYL

SEQ ID NO: 2414 - protein, 9 aa, synthetic construct
  REGION 1..9: note = Synthetic
LAWALMLAC

SEQ ID NO: 2415 - protein, 9 aa, synthetic construct
  REGION 1..9: note = Synthetic
LEAGRRFTH

SEQ ID NO: 2416 - protein, 9 aa, synthetic construct
  REGION 1..9: note = Synthetic
LFTQQGGAY

SEQ ID NO: 2417 - protein, 9 aa, synthetic construct
  REGION 1..9: note = Synthetic
LKRPGSSPM

SEQ ID NO: 2418 - protein, 9 aa, synthetic construct
  REGION 1..9: note = Synthetic
LLGSHVARA

SEQ ID NO: 2419 - protein, 9 aa, synthetic construct
  REGION 1..9: note = Synthetic
LLHHILPIL

SEQ ID NO: 2420 - protein, 9 aa, synthetic construct
  REGION 1..9: note = Synthetic
LLNAGGTLL

SEQ ID NO: 2421 - protein, 9 aa, synthetic construct
  REGION 1..9: note = Synthetic
LMGPLQVNA

SEQ ID NO: 2422 - protein, 9 aa, synthetic construct
  REGION 1..9: note = Synthetic
LNDSKITMG

SEQ ID NO: 2423 - protein, 9 aa, synthetic construct
  REGION 1..9: note = Synthetic
LPEPVKLTL

SEQ ID NO: 2424 - protein, 9 aa, synthetic construct
  REGION 1..9: note = Synthetic
LPILVLALL

SEQ ID NO: 2425 - protein, 9 aa, synthetic construct
  REGION 1..9: note = Synthetic
LPKISKNAL

SEQ ID NO: 2426 - protein, 9 aa, synthetic construct
  REGION 1..9: note = Synthetic
LPKPVTVKL

SEQ ID NO: 2427 - protein, 9 aa, synthetic construct
  REGION 1..9: note = Synthetic
LPLKANPMH

SEQ ID NO: 2428 - protein, 9 aa, synthetic construct
  REGION 1..9: note = Synthetic
LPPRPVVAE

SEQ ID NO: 2429 - protein, 9 aa, synthetic construct
  REGION 1..9: note = Synthetic
LPSIPGTSI

SEQ ID NO: 2430 - protein, 9 aa, synthetic construct
  REGION 1..9: note = Synthetic
LPTHLYKNF

SEQ ID NO: 2431 - protein, 9 aa, synthetic construct
  REGION 1..9: note = Synthetic
LPVRGVALV

SEQ ID NO: 2432 - protein, 9 aa, synthetic construct
  REGION 1..9: note = Synthetic
LPVSLTALD

SEQ ID NO: 2433 - protein, 9 aa, synthetic construct
  REGION 1..9: note = Synthetic
LQGGNKVPV

SEQ ID NO: 2434 - protein, 9 aa, synthetic construct
  REGION 1..9: note = Synthetic
LSAALGADW

SEQ ID NO: 2435 - protein, 9 aa, synthetic construct
  REGION 1..9: note = Synthetic
LSDAGHEHD

SEQ ID NO: 2436 - protein, 9 aa, synthetic construct
  REGION 1..9: note = Synthetic
LSGEVQRKG

SEQ ID NO: 2437 - protein, 9 aa, synthetic construct
  REGION 1..9: note = Synthetic
LSSPSAITV

SEQ ID NO: 2438 - protein, 9 aa, synthetic construct
  REGION 1..9: note = Synthetic
LTWLAILAV

SEQ ID NO: 2439 - protein, 9 aa, synthetic construct
  REGION 1..9: note = Synthetic
LVFSHVRGM

SEQ ID NO: 2440 - protein, 9 aa, synthetic construct
  REGION 1..9: note = Synthetic
LVSDAGADL

SEQ ID NO: 2441 - protein, 9 aa, synthetic construct
  REGION 1..9: note = Synthetic
LVYYESIAY

SEQ ID NO: 2442 - protein, 9 aa, synthetic construct
  REGION 1..9: note = Synthetic
MAAESTFES

SEQ ID NO: 2443 - protein, 9 aa, synthetic construct
  REGION 1..9: note = Synthetic
MAAGHDATL

SEQ ID NO: 2444 - protein, 9 aa, synthetic construct
  REGION 1..9: note = Synthetic
MAAWSERAG

SEQ ID NO: 2445 - protein, 9 aa, synthetic construct
  REGION 1..9: note = Synthetic
MALGALGAA

SEQ ID NO: 2446 - protein, 9 aa, synthetic construct
  REGION 1..9: note = Synthetic
MAPVMGACM

SEQ ID NO: 2447 - protein, 9 aa, synthetic construct
  REGION 1..9: note = Synthetic
MATKGEMQI

SEQ ID NO: 2448 - protein, 9 aa, synthetic construct
  REGION 1..9: note = Synthetic
MDAKGGTLL

SEQ ID NO: 2449 - protein, 9 aa, synthetic construct
  REGION 1..9: note = Synthetic
MESNKDIVI

SEQ ID NO: 2450 - protein, 9 aa, synthetic construct
  REGION 1..9: note = Synthetic
MEVMLRAVF

SEQ ID NO: 2451 - protein, 9 aa, synthetic construct
  REGION 1..9: note = Synthetic
MEYFKTPLP

SEQ ID NO: 2452 - protein, 9 aa, synthetic construct
  REGION 1..9: note = Synthetic
MHTIASILL

SEQ ID NO: 2453 - protein, 9 aa, synthetic construct
  REGION 1..9: note = Synthetic
MIYMSGLAV

SEQ ID NO: 2454 - protein, 9 aa, synthetic construct
  REGION 1..9: note = Synthetic
MLACTGLPL

SEQ ID NO: 2455 - protein, 9 aa, synthetic construct
  REGION 1..9: note = Synthetic
MPIDRKTLC

SEQ ID NO: 2456 - protein, 9 aa, synthetic construct
  REGION 1..9: note = Synthetic
MPKAPELDL

SEQ ID NO: 2457 - protein, 9 aa, synthetic construct
  REGION 1..9: note = Synthetic
MQRQAGLPL

SEQ ID NO: 2458 - protein, 9 aa, synthetic construct
  REGION 1..9: note = Synthetic
NALAWALML

SEQ ID NO: 2459 - protein, 9 aa, synthetic construct
  REGION 1..9: note = Synthetic
NITNKRAAL

SEQ ID NO: 2460 - protein, 9 aa, synthetic construct
  REGION 1..9: note = Synthetic
NLMAAESTF

SEQ ID NO: 2461 - protein, 9 aa, synthetic construct
  REGION 1..9: note = Synthetic
NNETMSGRQ

SEQ ID NO: 2462 - protein, 9 aa, synthetic construct
  REGION 1..9: note = Synthetic
NPGSLIAEV

SEQ ID NO: 2463 - protein, 9 aa, synthetic construct
  REGION 1..9: note = Synthetic
NPMHTIASI

SEQ ID NO: 2464 - protein, 9 aa, synthetic construct
  REGION 1..9: note = Synthetic
NPQTQLSNI

SEQ ID NO: 2465 - protein, 9 aa, synthetic construct
  REGION 1..9: note = Synthetic
NPYTSRRSV

SEQ ID NO: 2466 - protein, 9 aa, synthetic construct
  REGION 1..9: note = Synthetic
PAPTAPPMP

SEQ ID NO: 2467 - protein, 9 aa, synthetic construct
  REGION 1..9: note = Synthetic
PASANTLLL

SEQ ID NO: 2468 - protein, 9 aa, synthetic construct
  REGION 1..9: note = Synthetic
PAVALPRPL

SEQ ID NO: 2469 - protein, 9 aa, synthetic construct
  REGION 1..9: note = Synthetic
PDAHVPFCF

SEQ ID NO: 2470 - protein, 9 aa, synthetic construct
  REGION 1..9: note = Synthetic
PELGAAIRV

SEQ ID NO: 2471 - protein, 9 aa, synthetic construct
  REGION 1..9: note = Synthetic
PFIIKLKDC

SEQ ID NO: 2472 - protein, 9 aa, synthetic construct
  REGION 1..9: note = Synthetic
PGPQPPQPP

SEQ ID NO: 2473 - protein, 9 aa, synthetic construct
  REGION 1..9: note = Synthetic
PGPQPPQPQ

SEQ ID NO: 2474 - protein, 9 aa, synthetic construct
  REGION 1..9: note = Synthetic
PGPTTDYST

SEQ ID NO: 2475 - protein, 9 aa, synthetic construct
  REGION 1..9: note = Synthetic
PGTFTAGKD

SEQ ID NO: 2476 - protein, 9 aa, synthetic construct
  REGION 1..9: note = Synthetic
PGTPGDLLE

SEQ ID NO: 2477 - protein, 9 aa, synthetic construct
  REGION 1..9: note = Synthetic
PKPKPKAER

SEQ ID NO: 2478 - protein, 9 aa, synthetic construct
  REGION 1..9: note = Synthetic
PKPKPKPKA

SEQ ID NO: 2479 - protein, 9 aa, synthetic construct
  REGION 1..9: note = Synthetic
PKPKPKPKP

SEQ ID NO: 2480 - protein, 9 aa, synthetic construct
  REGION 1..9: note = Synthetic
PLPPRPVVA

SEQ ID NO: 2481 - protein, 9 aa, synthetic construct
  REGION 1..9: note = Synthetic
PPAPKPAPQ

SEQ ID NO: 2482 - protein, 9 aa, synthetic construct
  REGION 1..9: note = Synthetic
PPKPAPVAK

SEQ ID NO: 2483 - protein, 9 aa, synthetic construct
  REGION 1..9: note = Synthetic
PPRPVAAQV

SEQ ID NO: 2484 - protein, 9 aa, synthetic construct
  REGION 1..9: note = Synthetic
PPRPVVAEK

SEQ ID NO: 2485 - protein, 9 aa, synthetic construct
  REGION 1..9: note = Synthetic
PPSRPTTPP

SEQ ID NO: 2486 - protein, 9 aa, synthetic construct
  REGION 1..9: note = Synthetic
PRRARRALR

SEQ ID NO: 2487 - protein, 9 aa, synthetic construct
  REGION 1..9: note = Synthetic
QAAPLSITL

SEQ ID NO: 2488 - protein, 9 aa, synthetic construct
  REGION 1..9: note = Synthetic
QADRDFVWY

SEQ ID NO: 2489 - protein, 9 aa, synthetic construct
  REGION 1..9: note = Synthetic
QAIVVGKDL

SEQ ID NO: 2490 - protein, 9 aa, synthetic construct
  REGION 1..9: note = Synthetic
QALGALKLY

SEQ ID NO: 2491 - protein, 9 aa, synthetic construct
  REGION 1..9: note = Synthetic
QELALKLKG

SEQ ID NO: 2492 - protein, 9 aa, synthetic construct
  REGION 1..9: note = Synthetic
QITQHGGPY

SEQ ID NO: 2493 - protein, 9 aa, synthetic construct
  REGION 1..9: note = Synthetic
QITQHGSPY

SEQ ID NO: 2494 - protein, 9 aa, synthetic construct
  REGION 1..9: note = Synthetic
QPLPPRPVA

SEQ ID NO: 2495 - protein, 9 aa, synthetic construct
  REGION 1..9: note = Synthetic
QPPAGRELS

SEQ ID NO: 2496 - protein, 9 aa, synthetic construct
  REGION 1..9: note = Synthetic
QQLKQADRD

SEQ ID NO: 2497 - protein, 9 aa, synthetic construct
  REGION 1..9: note = Synthetic
QQVQVLQRQ

SEQ ID NO: 2498 - protein, 9 aa, synthetic construct
  REGION 1..9: note = Synthetic
QSIVEAPEL

SEQ ID NO: 2499 - protein, 9 aa, synthetic construct
  REGION 1..9: note = Synthetic
QVGSSNSAF

SEQ ID NO: 2500 - protein, 9 aa, synthetic construct
  REGION 1..9: note = Synthetic
RAGLSPATW

SEQ ID NO: 2501 - protein, 9 aa, synthetic construct
  REGION 1..9: note = Synthetic
RARRALRQD

SEQ ID NO: 2502 - protein, 9 aa, synthetic construct
  REGION 1..9: note = Synthetic
RASASRARI

SEQ ID NO: 2503 - protein, 9 aa, synthetic construct
  REGION 1..9: note = Synthetic
RELSAAANA

SEQ ID NO: 2504 - protein, 9 aa, synthetic construct
  REGION 1..9: note = Synthetic
RETFCITTI

SEQ ID NO: 2505 - protein, 9 aa, synthetic construct
  REGION 1..9: note = Synthetic
RGFAQRQQL

SEQ ID NO: 2506 - protein, 9 aa, synthetic construct
  REGION 1..9: note = Synthetic
RGSAATFTL

SEQ ID NO: 2507 - protein, 9 aa, synthetic construct
  REGION 1..9: note = Synthetic
RGWSIFALY

SEQ ID NO: 2508 - protein, 9 aa, synthetic construct
  REGION 1..9: note = Synthetic
RKMLYLIYV

SEQ ID NO: 2509 - protein, 9 aa, synthetic construct
  REGION 1..9: note = Synthetic
RLRKMLYLI

SEQ ID NO: 2510 - protein, 9 aa, synthetic construct
  REGION 1..9: note = Synthetic
RPQITDAVT

SEQ ID NO: 2511 - protein, 9 aa, synthetic construct
  REGION 1..9: note = Synthetic
RPSVNGGRI

SEQ ID NO: 2512 - protein, 9 aa, synthetic construct
  REGION 1..9: note = Synthetic
RRFTHADGW

SEQ ID NO: 2513 - protein, 9 aa, synthetic construct
  REGION 1..9: note = Synthetic
RSGARATSL

SEQ ID NO: 2514 - protein, 9 aa, synthetic construct
  REGION 1..9: note = Synthetic
RSRVRALAW

SEQ ID NO: 2515 - protein, 9 aa, synthetic construct
  REGION 1..9: note = Synthetic
RSRVRALSW

SEQ ID NO: 2516 - protein, 9 aa, synthetic construct
  REGION 1..9: note = Synthetic
RTHGVGASL

SEQ ID NO: 2517 - protein, 9 aa, synthetic construct
  REGION 1..9: note = Synthetic
RTRGQARSG

SEQ ID NO: 2518 - protein, 9 aa, synthetic construct
  REGION 1..9: note = Synthetic
RVAPPAVAL

SEQ ID NO: 2519 - protein, 9 aa, synthetic construct
  REGION 1..9: note = Synthetic
RVLPEPVKL

SEQ ID NO: 2520 - protein, 9 aa, synthetic construct
  REGION 1..9: note = Synthetic
RVRALAWLL

SEQ ID NO: 2521 - protein, 9 aa, synthetic construct
  REGION 1..9: note = Synthetic
RVRALSWLL

SEQ ID NO: 2522 - protein, 9 aa, synthetic construct
  REGION 1..9: note = Synthetic
RVTVSGGSL

SEQ ID NO: 2523 - protein, 9 aa, synthetic construct
  REGION 1..9: note = Synthetic
SEAMAAWSE

SEQ ID NO: 2524 - protein, 9 aa, synthetic construct
  REGION 1..9: note = Synthetic
SESHNFHAS

SEQ ID NO: 2525 - protein, 9 aa, synthetic construct
  REGION 1..9: note = Synthetic
SGEGRVNIG

SEQ ID NO: 2526 - protein, 9 aa, synthetic construct
  REGION 1..9: note = Synthetic
SGLAVRVHV

SEQ ID NO: 2527 - protein, 9 aa, synthetic construct
  REGION 1..9: note = Synthetic
SLADISLGA

SEQ ID NO: 2528 - protein, 9 aa, synthetic construct
  REGION 1..9: note = Synthetic
SLFAILSST

SEQ ID NO: 2529 - protein, 9 aa, synthetic construct
  REGION 1..9: note = Synthetic
SLFAPHGNV

SEQ ID NO: 2530 - protein, 9 aa, synthetic construct
  REGION 1..9: note = Synthetic
SLSIDNATW

SEQ ID NO: 2531 - protein, 9 aa, synthetic construct
  REGION 1..9: note = Synthetic
SPMEVMLRA

SEQ ID NO: 2532 - protein, 9 aa, synthetic construct
  REGION 1..9: note = Synthetic
SPQPIRATV

SEQ ID NO: 2533 - protein, 9 aa, synthetic construct
  REGION 1..9: note = Synthetic
SPRRARRAL

SEQ ID NO: 2534 - protein, 9 aa, synthetic construct
  REGION 1..9: note = Synthetic
SPSRLAGTL

SEQ ID NO: 2535 - protein, 9 aa, synthetic construct
  REGION 1..9: note = Synthetic
SSTPLGSLF

SEQ ID NO: 2536 - protein, 9 aa, synthetic construct
  REGION 1..9: note = Synthetic
STYELLDYL

SEQ ID NO: 2537 - protein, 9 aa, synthetic construct
  REGION 1..9: note = Synthetic
SVAMKPYEV

SEQ ID NO: 2538 - protein, 9 aa, synthetic construct
  REGION 1..9: note = Synthetic
SVAPNALAW

SEQ ID NO: 2539 - protein, 9 aa, synthetic construct
  REGION 1..9: note = Synthetic
SVKVAKKLF

SEQ ID NO: 2540 - protein, 9 aa, synthetic construct
  REGION 1..9: note = Synthetic
TAFMSGRSL

SEQ ID NO: 2541 - protein, 9 aa, synthetic construct
  REGION 1..9: note = Synthetic
TAGATPFDI

SEQ ID NO: 2542 - protein, 9 aa, synthetic construct
  REGION 1..9: note = Synthetic
TAPVTSPAW

SEQ ID NO: 2543 - protein, 9 aa, synthetic construct
  REGION 1..9: note = Synthetic
TARTGWLTW

SEQ ID NO: 2544 - protein, 9 aa, synthetic construct
  REGION 1..9: note = Synthetic
TEAQGVQVR

SEQ ID NO: 2545 - protein, 9 aa, synthetic construct
  REGION 1..9: note = Synthetic
TEVYLEHRM

SEQ ID NO: 2546 - protein, 9 aa, synthetic construct
  REGION 1..9: note = Synthetic
TFEGKPALE

SEQ ID NO: 2547 - protein, 9 aa, synthetic construct
  REGION 1..9: note = Synthetic
TFTGKVTNG

SEQ ID NO: 2548 - protein, 9 aa, synthetic construct
  REGION 1..9: note = Synthetic
TGDGGGHTD

SEQ ID NO: 2549 - protein, 9 aa, synthetic construct
  REGION 1..9: note = Synthetic
TLAKALSAA

SEQ ID NO: 2550 - protein, 9 aa, synthetic construct
  REGION 1..9: note = Synthetic
TLANVGDTW

SEQ ID NO: 2551 - protein, 9 aa, synthetic construct
  REGION 1..9: note = Synthetic
TLNASNLTL

SEQ ID NO: 2552 - protein, 9 aa, synthetic construct
  REGION 1..9: note = Synthetic
TLSSAHGNV

SEQ ID NO: 2553 - protein, 9 aa, synthetic construct
  REGION 1..9: note = Synthetic
TPFDIKLKE

SEQ ID NO: 2554 - protein, 9 aa, synthetic construct
  REGION 1..9: note = Synthetic
TPFIIKLKD

SEQ ID NO: 2555 - protein, 9 aa, synthetic construct
  REGION 1..9: note = Synthetic
TPGWSIYGL

SEQ ID NO: 2556 - protein, 9 aa, synthetic construct
  REGION 1..9: note = Synthetic
TPLGSAATF

SEQ ID NO: 2557 - protein, 9 aa, synthetic construct
  REGION 1..9: note = Synthetic
TPLGSLFAI

SEQ ID NO: 2558 - protein, 9 aa, synthetic construct
  REGION 1..9: note = Synthetic
TPLPVSLTA

SEQ ID NO: 2559 - protein, 9 aa, synthetic construct
  REGION 1..9: note = Synthetic
TRQGIMDQY

SEQ ID NO: 2560 - protein, 9 aa, synthetic construct
  REGION 1..9: note = Synthetic
TSKQDERNY

SEQ ID NO: 2561 - protein, 9 aa, synthetic construct
  REGION 1..9: note = Synthetic
TSPYDGKYW

SEQ ID NO: 2562 - protein, 9 aa, synthetic construct
  REGION 1..9: note = Synthetic
TSRRSVASI

SEQ ID NO: 2563 - protein, 9 aa, synthetic construct
  REGION 1..9: note = Synthetic
TSRTVTMRY

SEQ ID NO: 2564 - protein, 9 aa, synthetic construct
  REGION 1..9: note = Synthetic
TTEYPNARY

SEQ ID NO: 2565 - protein, 9 aa, synthetic construct
  REGION 1..9: note = Synthetic
TTEYSNARY

SEQ ID NO: 2566 - protein, 9 aa, synthetic construct
  REGION 1..9: note = Synthetic
TTLGLEQTF

SEQ ID NO: 2567 - protein, 9 aa, synthetic construct
  REGION 1..9: note = Synthetic
TVLAAGAGL

SEQ ID NO: 2568 - protein, 9 aa, synthetic construct
  REGION 1..9: note = Synthetic
TVQELALKL

SEQ ID NO: 2569 - protein, 9 aa, synthetic construct
  REGION 1..9: note = Synthetic
TVVQRNKHW

SEQ ID NO: 2570 - protein, 9 aa, synthetic construct
  REGION 1..9: note = Synthetic
VAAAADLAL

SEQ ID NO: 2571 - protein, 9 aa, synthetic construct
  REGION 1..9: note = Synthetic
VALASQARW

SEQ ID NO: 2572 - protein, 9 aa, synthetic construct
  REGION 1..9: note = Synthetic
VAMKPYEVT

SEQ ID NO: 2573 - protein, 9 aa, synthetic construct
  REGION 1..9: note = Synthetic
VARLVKLQG

SEQ ID NO: 2574 - protein, 9 aa, synthetic construct
  REGION 1..9: note = Synthetic
VAVAGGRWH

SEQ ID NO: 2575 - protein, 9 aa, synthetic construct
  REGION 1..9: note = Synthetic
VEASAITTY

SEQ ID NO: 2576 - protein, 9 aa, synthetic construct
  REGION 1..9: note = Synthetic
VEDIGGKNY

SEQ ID NO: 2577 - protein, 9 aa, synthetic construct
  REGION 1..9: note = Synthetic
VEVSSPPPV

SEQ ID NO: 2578 - protein, 9 aa, synthetic construct
  REGION 1..9: note = Synthetic
VGAGGYEAG

SEQ ID NO: 2579 - protein, 9 aa, synthetic construct
  REGION 1..9: note = Synthetic
VGGGEHGRW

SEQ ID NO: 2580 - protein, 9 aa, synthetic construct
  REGION 1..9: note = Synthetic
VHVSKEEQY

SEQ ID NO: 2581 - protein, 9 aa, synthetic construct
  REGION 1..9: note = Synthetic
VIDGQKVLA

SEQ ID NO: 2582 - protein, 9 aa, synthetic construct
  REGION 1..9: note = Synthetic
VIGACTSPY

SEQ ID NO: 2583 - protein, 9 aa, synthetic construct
  REGION 1..9: note = Synthetic
VKLGGVYEA

SEQ ID NO: 2584 - protein, 9 aa, synthetic construct
  REGION 1..9: note = Synthetic
VLAPRLYLT

SEQ ID NO: 2585 - protein, 9 aa, synthetic construct
  REGION 1..9: note = Synthetic
VLVKTNMVV

SEQ ID NO: 2586 - protein, 9 aa, synthetic construct
  REGION 1..9: note = Synthetic
VPASGAPAA

SEQ ID NO: 2587 - protein, 9 aa, synthetic construct
  REGION 1..9: note = Synthetic
VPFCFGKDL

SEQ ID NO: 2588 - protein, 9 aa, synthetic construct
  REGION 1..9: note = Synthetic
VPVSEHCTV

SEQ ID NO: 2589 - protein, 9 aa, synthetic construct
  REGION 1..9: note = Synthetic
VPVTPPKVE

SEQ ID NO: 2590 - protein, 9 aa, synthetic construct
  REGION 1..9: note = Synthetic
VRTVSAMEY

SEQ ID NO: 2591 - protein, 9 aa, synthetic construct
  REGION 1..9: note = Synthetic
VSGGSLSAP

SEQ ID NO: 2592 - protein, 9 aa, synthetic construct
  REGION 1..9: note = Synthetic
VSSATKAKG

SEQ ID NO: 2593 - protein, 9 aa, synthetic construct
  REGION 1..9: note = Synthetic
VSSPPPVSV

SEQ ID NO: 2594 - protein, 9 aa, synthetic construct
  REGION 1..9: note = Synthetic
VSVKVAKKL

SEQ ID NO: 2595 - protein, 9 aa, synthetic construct
  REGION 1..9: note = Synthetic
VTMRYLASY

SEQ ID NO: 2596 - protein, 9 aa, synthetic construct
  REGION 1..9: note = Synthetic
VTSVAMKPY

SEQ ID NO: 2597 - protein, 9 aa, synthetic construct
  REGION 1..9: note = Synthetic
VVAEKVTTP

SEQ ID NO: 2598 - protein, 9 aa, synthetic construct
  REGION 1..9: note = Synthetic
VVDGPPSRP

SEQ ID NO: 2599 - protein, 9 aa, synthetic construct
  REGION 1..9: note = Synthetic
VVETAQPLP

SEQ ID NO: 2600 - protein, 9 aa, synthetic construct
  REGION 1..9: note = Synthetic
WLTWLAILA

SEQ ID NO: 2601 - protein, 9 aa, synthetic construct
  REGION 1..9: note = Synthetic
WTFHAGYRY

SEQ ID NO: 2602 - protein, 9 aa, synthetic construct
  REGION 1..9: note = Synthetic
WVMTDNSNV

SEQ ID NO: 2603 - protein, 9 aa, synthetic construct
  REGION 1..9: note = Synthetic
YAEHGEVSI

SEQ ID NO: 2604 - protein, 9 aa, synthetic construct
  REGION 1..9: note = Synthetic
YAIDGTAAG

SEQ ID NO: 2605 - protein, 9 aa, synthetic construct
  REGION 1..9: note = Synthetic
YALKSRIAL

SEQ ID NO: 2606 - protein, 9 aa, synthetic construct
  REGION 1..9: note = Synthetic
YATNPQTQL

SEQ ID NO: 2607 - protein, 9 aa, synthetic construct
  REGION 1..9: note = Synthetic
YDTGDLIAY

SEQ ID NO: 2608 - protein, 9 aa, synthetic construct
  REGION 1..9: note = Synthetic
YEAGFSLGS

SEQ ID NO: 2609 - protein, 9 aa, synthetic construct
  REGION 1..9: note = Synthetic
YEDATFETY

SEQ ID NO: 2610 - protein, 9 aa, synthetic construct
  REGION 1..9: note = Synthetic
YENKSSTPL

SEQ ID NO: 2611 - protein, 9 aa, synthetic construct
  REGION 1..9: note = Synthetic
YEVTPTRML

SEQ ID NO: 2612 - protein, 9 aa, synthetic construct
  REGION 1..9: note = Synthetic
YEYIWGLYP

SEQ ID NO: 2613 - protein, 9 aa, synthetic construct
  REGION 1..9: note = Synthetic
YEYIWGLYQ

SEQ ID NO: 2614 - protein, 9 aa, synthetic construct
  REGION 1..9: note = Synthetic
YEYSKGPKL

SEQ ID NO: 2615 - protein, 9 aa, synthetic construct
  REGION 1..9: note = Synthetic
YFEPGPTTD

SEQ ID NO: 2616 - protein, 9 aa, synthetic construct
  REGION 1..9: note = Synthetic
YIWGLYPTY

SEQ ID NO: 2617 - protein, 9 aa, synthetic construct
  REGION 1..9: note = Synthetic
YIWGLYQTY

SEQ ID NO: 2618 - protein, 9 aa, synthetic construct
  REGION 1..9: note = Synthetic
YLRQITPGW

SEQ ID NO: 2619 - protein, 9 aa, synthetic construct
  REGION 1..9: note = Synthetic
YMIYMSGLA

SEQ ID NO: 2620 - protein, 9 aa, synthetic construct
  REGION 1..9: note = Synthetic
YPALRAALI

SEQ ID NO: 2621 - protein, 9 aa, synthetic construct
  REGION 1..9: note = Synthetic
YPGTPGDLL

SEQ ID NO: 2622 - protein, 9 aa, synthetic construct
  REGION 1..9: note = Synthetic
YPTYTEWSV

SEQ ID NO: 2623 - protein, 9 aa, synthetic construct
  REGION 1..9: note = Synthetic
YQTYTEWSV

SEQ ID NO: 2624 - protein, 9 aa, synthetic construct
  REGION 1..9: note = Synthetic
YSTGDLRAY

SEQ ID NO: 2625 - protein, 9 aa, synthetic construct
  REGION 1..9: note = Synthetic
YTLRYLASY

SEQ ID NO: 2626 - protein, 9 aa, synthetic construct
  REGION 1..9: note = Synthetic
YVLVKTNMV

SEQ ID NO: 2627 - protein, 9 aa, synthetic construct
  REGION 1..9: note = Synthetic
YYDYEDATF

SEQ ID NO: 2628 - protein, 15 aa, synthetic construct
  REGION 1..15: note = Synthetic
AAFIALYPNSQLAPT

SEQ ID NO: 2629 - protein, 14 aa, synthetic construct
  REGION 1..14: note = Synthetic
GGAEYNLALGQRRA

SEQ ID NO: 2630 - protein, 16 aa, synthetic construct
  REGION 1..16: note = Synthetic
GGAEYNLALGQRRADA

SEQ ID NO: 2631 - protein, 12 aa, synthetic construct
  REGION 1..12: note = Synthetic
IALYPNSQLAPT

SEQ ID NO: 2632 - protein, 18 aa, synthetic construct
  REGION 1..18: note = Synthetic
KPDQGEVVAVGPGKKTED

SEQ ID NO: 2633 - protein, 19 aa, synthetic construct
  REGION 1..19: note = Synthetic
KPDQGEVVAVGPGKKTEDG

SEQ ID NO: 2634 - protein, 14 aa, synthetic construct
  REGION 1..14: note = Synthetic
LAEVLDYHNFVLTQ

SEQ ID NO: 2635 - protein, 15 aa, synthetic construct
  REGION 1..15: note = Synthetic
QSIALSSLMVAQAIP

SEQ ID NO: 2636 - protein, 23 aa, synthetic construct
  REGION 1..23: note = Synthetic
SIGVLGYQKTVDHTKVNSKLSLF

SEQ ID NO: 2637 - protein, 14 aa, synthetic construct
  REGION 1..14: note = Synthetic
AAHADWNNQSIVKT

SEQ ID NO: 2638 - protein, 6 aa, synthetic construct
  REGION 1..6: note = Synthetic
AALGRG

SEQ ID NO: 2639 - protein, 14 aa, synthetic construct
  REGION 1..14: note = Synthetic
AALGRGHSLYASYE

SEQ ID NO: 2640 - protein, 14 aa, synthetic construct
  REGION 1..14: note = Synthetic
AAPLRRTTLAMALG

SEQ ID NO: 2641 - protein, 14 aa, synthetic construct
  REGION 1..14: note = Synthetic
AAPLSITLQAGAHA

SEQ ID NO: 2642 - protein, 14 aa, synthetic construct
  REGION 1..14: note = Synthetic
ADAQGDIVATELPS

SEQ ID NO: 2643 - protein, 14 aa, synthetic construct
  REGION 1..14: note = Synthetic
ADSGFYLDATLRAS

SEQ ID NO: 2644 - protein, 4 aa, synthetic construct
  REGION 1..4: note = Synthetic
AELA

SEQ ID NO: 2645 - protein, 14 aa, synthetic construct
  REGION 1..14: note = Synthetic
AELAVFRAGGGAYR

SEQ ID NO: 2646 - protein, 14 aa, synthetic construct
  REGION 1..14: note = Synthetic
AELQFRNGSVTSSG

SEQ ID NO: 2647 - protein, 14 aa, synthetic construct
  REGION 1..14: note = Synthetic
AGGRWHLGGLAGYT

SEQ ID NO: 2648 - protein, 14 aa, synthetic construct
  REGION 1..14: note = Synthetic
AGVAAMQGAVVHLQ

SEQ ID NO: 2649 - protein, 14 aa, synthetic construct
  REGION 1..14: note = Synthetic
AGYTRGDRGFTGDG

SEQ ID NO: 2650 - protein, 14 aa, synthetic construct
  REGION 1..14: note = Synthetic
ALASQARWTGATRA

SEQ ID NO: 2651 - protein, 14 aa, synthetic construct
  REGION 1..14: note = Synthetic
AMPWTFHAGYRYSW

SEQ ID NO: 2652 - protein, 20 aa, synthetic construct
  REGION 1..20: note = Synthetic
AMQGAVVHLQRATIRRGDAP

SEQ ID NO: 2653 - protein, 9 aa, synthetic construct
  REGION 1..9: note = Synthetic
ANGLRVRDE

SEQ ID NO: 2654 - protein, 14 aa, synthetic construct
  REGION 1..14: note = Synthetic
ANGLRVRDEGGSSV

SEQ ID NO: 2655 - protein, 14 aa, synthetic construct
  REGION 1..14: note = Synthetic
ANKDGKVDIGTYRY

SEQ ID NO: 2656 - protein, 14 aa, synthetic construct
  REGION 1..14: note = Synthetic
APAAVSVLGASELT

SEQ ID NO: 2657 - protein, 14 aa, synthetic construct
  REGION 1..14: note = Synthetic
APPAPKPAPQPGPQ

SEQ ID NO: 2658 - protein, 14 aa, synthetic construct
  REGION 1..14: note = Synthetic
AQGILLENPAAELQ

SEQ ID NO: 2659 - protein, 14 aa, synthetic construct
  REGION 1..14: note = Synthetic
ARWTGATRAVDSLS

SEQ ID NO: 2660 - protein, 14 aa, synthetic construct
  REGION 1..14: note = Synthetic
ASLEAGRRFTHADG

SEQ ID NO: 2661 - protein, 14 aa, synthetic construct
  REGION 1..14: note = Synthetic
ASYEYSKGPKLAMP

SEQ ID NO: 2662 - protein, 9 aa, synthetic construct
  REGION 1..9: note = Synthetic
ATFTLANKD

SEQ ID NO: 2663 - protein, 14 aa, synthetic construct
  REGION 1..14: note = Synthetic
ATFTLANKDGKVDI

SEQ ID NO: 2664 - protein, 14 aa, synthetic construct
  REGION 1..14: note = Synthetic
ATRAVDSLSIDNAT

SEQ ID NO: 2665 - protein, 15 aa, synthetic construct
  REGION 1..15: note = Synthetic
DDDGIALYVAGEQAQ

SEQ ID NO: 2666 - protein, 14 aa, synthetic construct
  REGION 1..14: note = Synthetic
DDGIALYVAGEQAQ

SEQ ID NO: 2667 - protein, 14 aa, synthetic construct
  REGION 1..14: note = Synthetic
DGGHITGGRAAGVA

SEQ ID NO: 2668 - protein, 16 aa, synthetic construct
  REGION 1..16: note = Synthetic
DGIRRFLGTVTVKAGK

SEQ ID NO: 2669 - protein, 14 aa, synthetic construct
  REGION 1..14: note = Synthetic
DGSVDFQQPAEAGR

SEQ ID NO: 2670 - protein, 14 aa, synthetic construct
  REGION 1..14: note = Synthetic
DGYAVKGKYRTHGV

SEQ ID NO: 2671 - protein, 14 aa, synthetic construct
  REGION 1..14: note = Synthetic
DIVATELPSIPGTS

SEQ ID NO: 2672 - protein, 14 aa, synthetic construct
  REGION 1..14: note = Synthetic
DKLVVMQDASGQHR

SEQ ID NO: 2673 - protein, 14 aa, synthetic construct
  REGION 1..14: note = Synthetic
DLGLSDKLVVMQDA

SEQ ID NO: 2674 - protein, 15 aa, synthetic construct
  REGION 1..15: note = Synthetic
DNATWVMTDNSNVGA

SEQ ID NO: 2675 - protein, 19 aa, synthetic construct
  REGION 1..19: note = Synthetic
DNATWVMTDNSNVGALRLA

SEQ ID NO: 2676 - protein, 14 aa, synthetic construct
  REGION 1..14: note = Synthetic
DNRAGRRFDQKVAG

SEQ ID NO: 2677 - protein, 14 aa, synthetic construct
  REGION 1..14: note = Synthetic
EAGRFKVLTVNTLA

SEQ ID NO: 2678 - protein, 14 aa, synthetic construct
  REGION 1..14: note = Synthetic
ELAQSIVEAPELGA

SEQ ID NO: 2679 - protein, 14 aa, synthetic construct
  REGION 1..14: note = Synthetic
ELGAAIRVGRGARV

SEQ ID NO: 2680 - protein, 14 aa, synthetic construct
  REGION 1..14: note = Synthetic
ELGADHAVAVAGGR

SEQ ID NO: 2681 - protein, 14 aa, synthetic construct
  REGION 1..14: note = Synthetic
ELPSIPGTSIGPLD

SEQ ID NO: 2682 - protein, 14 aa, synthetic construct
  REGION 1..14: note = Synthetic
EPVKLTLTGGADAQ

SEQ ID NO: 2683 - protein, 14 aa, synthetic construct
  REGION 1..14: note = Synthetic
EQAQASIADSTLQG

SEQ ID NO: 2684 - protein, 14 aa, synthetic construct
  REGION 1..14: note = Synthetic
ERGANVTVQRSAIV

SEQ ID NO: 2685 - protein, 14 aa, synthetic construct
  REGION 1..14: note = Synthetic
ERQHGIHIQGSDPG

SEQ ID NO: 2686 - protein, 14 aa, synthetic construct
  REGION 1..14: note = Synthetic
EVGKRIELAGGRQV

SEQ ID NO: 2687 - protein, 14 aa, synthetic construct
  REGION 1..14: note = Synthetic
FDGAGTVHTNGIAH

SEQ ID NO: 2688 - protein, 14 aa, synthetic construct
  REGION 1..14: note = Synthetic
FQQPAEAGRFKVLT

SEQ ID NO: 2689 - protein, 14 aa, synthetic construct
  REGION 1..14: note = Synthetic
FRAGGGAYRAANGL

SEQ ID NO: 2690 - protein, 14 aa, synthetic construct
  REGION 1..14: note = Synthetic
GAHAQGKALLYRVL

SEQ ID NO: 2691 - protein, 14 aa, synthetic construct
  REGION 1..14: note = Synthetic
GARVTVSGGSLSAP

SEQ ID NO: 2692 - protein, 14 aa, synthetic construct
  REGION 1..14: note = Synthetic
GAYRAANGLRVRDE

SEQ ID NO: 2693 - protein, 14 aa, synthetic construct
  REGION 1..14: note = Synthetic
GDAPAGGAVPGGAV

SEQ ID NO: 2694 - protein, 14 aa, synthetic construct
  REGION 1..14: note = Synthetic
GGAVPGGAVPGGFG

SEQ ID NO: 2695 - protein, 14 aa, synthetic construct
  REGION 1..14: note = Synthetic
GGAVPGGFGPVLDG

SEQ ID NO: 2696 - protein, 14 aa, synthetic construct
  REGION 1..14: note = Synthetic
GGFGPVLDGWYGVD

SEQ ID NO: 2697 - protein, 14 aa, synthetic construct
  REGION 1..14: note = Synthetic
GGLHIGALQSLQPE

SEQ ID NO: 2698 - protein, 14 aa, synthetic construct
  REGION 1..14: note = Synthetic
GGVQIERGANVTVQ

SEQ ID NO: 2699 - protein, 14 aa, synthetic construct
  REGION 1..14: note = Synthetic
GHSLYASYEYSKGP

SEQ ID NO: 2700 - protein, 14 aa, synthetic construct
  REGION 1..14: note = Synthetic
GHTDSVHVGGYATY

SEQ ID NO: 2701 - protein, 14 aa, synthetic construct
  REGION 1..14: note = Synthetic
GIAHRTELRGTRAE

SEQ ID NO: 2702 - protein, 14 aa, synthetic construct
  REGION 1..14: note = Synthetic
GKALLYRVLPEPVK

SEQ ID NO: 2703 - protein, 14 aa, synthetic construct
  REGION 1..14: note = Synthetic
GLGMAAALGRGHSL

SEQ ID NO: 2704 - protein, 14 aa, synthetic construct
  REGION 1..14: note = Synthetic
GNVIETGGARRFAP

SEQ ID NO: 2705 - protein, 14 aa, synthetic construct
  REGION 1..14: note = Synthetic
GPLDVALASQARWT

SEQ ID NO: 2706 - protein, 9 aa, synthetic construct
  REGION 1..9: note = Synthetic
GQHRLWVRN

SEQ ID NO: 2707 - protein, 14 aa, synthetic construct
  REGION 1..14: note = Synthetic
GRGFAQRQQLDNRA

SEQ ID NO: 2708 - protein, 14 aa, synthetic construct
  REGION 1..14: note = Synthetic
GRLGLEVGKRIELA

SEQ ID NO: 2709 - protein, 14 aa, synthetic construct
  REGION 1..14: note = Synthetic
GRQVQPYIKASVLQ

SEQ ID NO: 2710 - protein, 19 aa, synthetic construct
  REGION 1..19: note = Synthetic
GRRFTHADGWFLEPQAELA

SEQ ID NO: 2711 - protein, 14 aa, synthetic construct
  REGION 1..14: note = Synthetic
GSEPASANTLLLVQ

SEQ ID NO: 2712 - protein, 14 aa, synthetic construct
  REGION 1..14: note = Synthetic
GSSVLGRLGLEVGK

SEQ ID NO: 2713 - protein, 14 aa, synthetic construct
  REGION 1..14: note = Synthetic
GTTIKVSGRQAQGI

SEQ ID NO: 2714 - protein, 14 aa, synthetic construct
  REGION 1..14: note = Synthetic
GTVTVKAGKLVADH

SEQ ID NO: 2715 - protein, 14 aa, synthetic construct
  REGION 1..14: note = Synthetic
HAVAVAGGRWHLGG

SEQ ID NO: 2716 - protein, 14 aa, synthetic construct
  REGION 1..14: note = Synthetic
IELAGGRQVQPYIK

SEQ ID NO: 2717 - protein, 14 aa, synthetic construct
  REGION 1..14: note = Synthetic
IHIQGSDPGGVRTA

SEQ ID NO: 2718 - protein, 14 aa, synthetic construct
  REGION 1..14: note = Synthetic
IRRFLGTVTVKAGK

SEQ ID NO: 2719 - protein, 14 aa, synthetic construct
  REGION 1..14: note = Synthetic
IRVGRGARVTVSGG

SEQ ID NO: 2720 - protein, 9 aa, synthetic construct
  REGION 1..9: note = Synthetic
ITLQAGAHA

SEQ ID NO: 2721 - protein, 14 aa, synthetic construct
  REGION 1..14: note = Synthetic
ITLQAGAHAQGKAL

SEQ ID NO: 2722 - protein, 14 aa, synthetic construct
  REGION 1..14: note = Synthetic
IVEAPELGAAIRVG

SEQ ID NO: 2723 - protein, 14 aa, synthetic construct
  REGION 1..14: note = Synthetic
IVKTGERQHGIHIQ

SEQ ID NO: 2724 - protein, 14 aa, synthetic construct
  REGION 1..14: note = Synthetic
KAGKLVADHATLAN

SEQ ID NO: 2725 - protein, 14 aa, synthetic construct
  REGION 1..14: note = Synthetic
KGKYRTHGVGASLE

SEQ ID NO: 2726 - protein, 14 aa, synthetic construct
  REGION 1..14: note = Synthetic
KPAPQPGPQPPQPP

SEQ ID NO: 2727 - protein, 14 aa, synthetic construct
  REGION 1..14: note = Synthetic
KVAGFELGADHAVA

SEQ ID NO: 2728 - protein, 14 aa, synthetic construct
  REGION 1..14: note = Synthetic
KVAGSDGYAVKGKY

SEQ ID NO: 2729 - protein, 14 aa, synthetic construct
  REGION 1..14: note = Synthetic
KVDIGTYRYRLAAN

SEQ ID NO: 2730 - protein, 14 aa, synthetic construct
  REGION 1..14: note = Synthetic
KVLTVNTLAGSGLF

SEQ ID NO: 2731 - protein, 14 aa, synthetic construct
  REGION 1..14: note = Synthetic
LAANGNGQWSLVGA

SEQ ID NO: 2732 - protein, 14 aa, synthetic construct
  REGION 1..14: note = Synthetic
LAMPWTFHAGYRYS

SEQ ID NO: 2733 - protein, 14 aa, synthetic construct
  REGION 1..14: note = Synthetic
LASTLWYAESNALS

SEQ ID NO: 2734 - protein, 14 aa, synthetic construct
  REGION 1..14: note = Synthetic
LENDFKVAGSDGYA

SEQ ID NO: 2735 - protein, 14 aa, synthetic construct
  REGION 1..14: note = Synthetic
LENPAAELQFRNGS

SEQ ID NO: 2736 - protein, 14 aa, synthetic construct
  REGION 1..14: note = Synthetic
LGAAPAAHADWNNQ

SEQ ID NO: 2737 - protein, 18 aa, synthetic construct
  REGION 1..18: note = Synthetic
LGGLAGYTRGDRGFTGDG

SEQ ID NO: 2738 - protein, 5 aa, synthetic construct
  REGION 1..5: note = Synthetic
LLENP

SEQ ID NO: 2739 - protein, 14 aa, synthetic construct
  REGION 1..14: note = Synthetic
LLVQTPLGSAATFT

SEQ ID NO: 2740 - protein, 14 aa, synthetic construct
  REGION 1..14: note = Synthetic
LPPSRVVLRDTNVT

SEQ ID NO: 2741 - protein, 9 aa, synthetic construct
  REGION 1..9: note = Synthetic
LQPEDLPPS

SEQ ID NO: 2742 - protein, 14 aa, synthetic construct
  REGION 1..14: note = Synthetic
LQPEDLPPSRVVLR

SEQ ID NO: 2743 - protein, 14 aa, synthetic construct
  REGION 1..14: note = Synthetic
LRASRLENDFKVAG

SEQ ID NO: 2744 - protein, 14 aa, synthetic construct
  REGION 1..14: note = Synthetic
LRLASDGSVDFQQP

SEQ ID NO: 2745 - protein, 14 aa, synthetic construct
  REGION 1..14: note = Synthetic
LSAAANAAVNTGGV

SEQ ID NO: 2746 - protein, 14 aa, synthetic construct
  REGION 1..14: note = Synthetic
LSAPHGNVIETGGA

SEQ ID NO: 2747 - protein, 14 aa, synthetic construct
  REGION 1..14: note = Synthetic
LSDDGIRRFLGTVT

SEQ ID NO: 2748 - protein, 14 aa, synthetic construct
  REGION 1..14: note = Synthetic
LVGAKAPPAPKPAP

SEQ ID NO: 2749 - protein, 14 aa, synthetic construct
  REGION 1..14: note = Synthetic
LYVAGEQAQASIAD

SEQ ID NO: 2750 - protein, 14 aa, synthetic construct
  REGION 1..14: note = Synthetic
MALGALGAAPAAHA

SEQ ID NO: 2751 - protein, 14 aa, synthetic construct
  REGION 1..14: note = Synthetic
MNMSLSRIVKAAPL

SEQ ID NO: 2752 - protein, 9 aa, synthetic construct
  REGION 1..9: note = Synthetic
MQDASGQHR

SEQ ID NO: 2753 - protein, 14 aa, synthetic construct
  REGION 1..14: note = Synthetic
MQGAVVHLQRATIR

SEQ ID NO: 2754 - protein, 14 aa, synthetic construct
  REGION 1..14: note = Synthetic
NAAVNTGGVGLAST

SEQ ID NO: 2755 - protein, 14 aa, synthetic construct
  REGION 1..14: note = Synthetic
NALSKRLGELRLNP

SEQ ID NO: 2756 - protein, 14 aa, synthetic construct
  REGION 1..14: note = Synthetic
NGQWSLVGAKAPPA

SEQ ID NO: 2757 - protein, 14 aa, synthetic construct
  REGION 1..14: note = Synthetic
NTLAGSGLFRMNVF

SEQ ID NO: 2758 - protein, 14 aa, synthetic construct
  REGION 1..14: note = Synthetic
PAGRELSAAANAAV

SEQ ID NO: 2759 - protein, 14 aa, synthetic construct
  REGION 1..14: note = Synthetic
PAPQPPAGRELSAA

SEQ ID NO: 2760 - protein, 14 aa, synthetic construct
  REGION 1..14: note = Synthetic
PGPQPPQPPQPQPE

SEQ ID NO: 2761 - protein, 14 aa, synthetic construct
  REGION 1..14: note = Synthetic
PGTSIGPLDVALAS

SEQ ID NO: 2762 - protein, 14 aa, synthetic construct
  REGION 1..14: note = Synthetic
PLGSAATFTLANKD

SEQ ID NO: 2763 - protein, 14 aa, synthetic construct
  REGION 1..14: note = Synthetic
PQPEAPAPQPPAGR

SEQ ID NO: 2764 - protein, 14 aa, synthetic construct
  REGION 1..14: note = Synthetic
PQPPQPQPEAPAPQ

SEQ ID NO: 2765 - protein, 14 aa, synthetic construct
  REGION 1..14: note = Synthetic
PYIKASVLQEFDGA

SEQ ID NO: 2766 - protein, 14 aa, synthetic construct
  REGION 1..14: note = Synthetic
RFAPQAAPLSITLQ

SEQ ID NO: 2767 - protein, 14 aa, synthetic construct
  REGION 1..14: note = Synthetic
RLGELRLNPDAGGA

SEQ ID NO: 2768 - protein, 14 aa, synthetic construct
  REGION 1..14: note = Synthetic
RLNPDAGGAWGRGF

SEQ ID NO: 2769 - protein, 14 aa, synthetic construct
  REGION 1..14: note = Synthetic
RNGSVTSSGQLSDD

SEQ ID NO: 2770 - protein, 14 aa, synthetic construct
  REGION 1..14: note = Synthetic
RRFDQKVAGFELGA

SEQ ID NO: 2771 - protein, 14 aa, synthetic construct
  REGION 1..14: note = Synthetic
RTTLAMALGALGAA

SEQ ID NO: 2772 - protein, 14 aa, synthetic construct
  REGION 1..14: note = Synthetic
SAIVDGGLHIGALQ

SEQ ID NO: 2773 - protein, 14 aa, synthetic construct
  REGION 1..14: note = Synthetic
SANTLLLVQTPLGS

SEQ ID NO: 2774 - protein, 14 aa, synthetic construct
  REGION 1..14: note = Synthetic
SDPGGVRTASGTTI

SEQ ID NO: 2775 - protein, 14 aa, synthetic construct
  REGION 1..14: note = Synthetic
SELTLDGGHITGGR

SEQ ID NO: 2776 - protein, 9 aa, synthetic construct
  REGION 1..9: note = Synthetic
SGLFRMNVF

SEQ ID NO: 2777 - protein, 14 aa, synthetic construct
  REGION 1..14: note = Synthetic
SGLFRMNVFADLGL

SEQ ID NO: 2778 - protein, 14 aa, synthetic construct
  REGION 1..14: note = Synthetic
SGSSVELAQSIVEA

SEQ ID NO: 2779 - protein, 14 aa, synthetic construct
  REGION 1..14: note = Synthetic
SIADSTLQGAGGVQ

SEQ ID NO: 2780 - protein, 14 aa, synthetic construct
  REGION 1..14: note = Synthetic
SKGPKLAMPWTFHA

SEQ ID NO: 2781 - protein, 14 aa, synthetic construct
  REGION 1..14: note = Synthetic
SNVGALRLASDGSV

SEQ ID NO: 2782 - protein, 14 aa, synthetic construct
  REGION 1..14: note = Synthetic
SRIVKAAPLRRTTL

SEQ ID NO: 2783 - protein, 14 aa, synthetic construct
  REGION 1..14: note = Synthetic
SVLGASELTLDGGH

SEQ ID NO: 2784 - protein, 9 aa, synthetic construct
  REGION 1..9: note = Synthetic
SVLQEFDGA

SEQ ID NO: 2785 - protein, 14 aa, synthetic construct
  REGION 1..14: note = Synthetic
SVLQEFDGAGTVHT

SEQ ID NO: 2786 - protein, 4 aa, synthetic construct
  REGION 1..4: note = Synthetic
TELR

SEQ ID NO: 2787 - protein, 14 aa, synthetic construct
  REGION 1..14: note = Synthetic
TELRGTRAELGLGM

SEQ ID NO: 2788 - protein, 14 aa, synthetic construct
  REGION 1..14: note = Synthetic
TGDGGGHTDSVHVG

SEQ ID NO: 2789 - protein, 14 aa, synthetic construct
  REGION 1..14: note = Synthetic
TGGARRFAPQAAPL

SEQ ID NO: 2790 - protein, 14 aa, synthetic construct
  REGION 1..14: note = Synthetic
TGGRAAGVAAMQGA

SEQ ID NO: 2791 - protein, 14 aa, synthetic construct
  REGION 1..14: note = Synthetic
TGGVGLASTLWYAE

SEQ ID NO: 2792 - protein, 14 aa, synthetic construct
  REGION 1..14: note = Synthetic
THGVGASLEAGRRF

SEQ ID NO: 2793 - protein, 9 aa, synthetic construct
  REGION 1..9: note = Synthetic
TIRRGDAPA

SEQ ID NO: 2794 - protein, 14 aa, synthetic construct
  REGION 1..14: note = Synthetic
TLANVGDTWDDDGI

SEQ ID NO: 2795 - protein, 14 aa, synthetic construct
  REGION 1..14: note = Synthetic
TLQGAGGVQIERGA

SEQ ID NO: 2796 - protein, 14 aa, synthetic construct
  REGION 1..14: note = Synthetic
TLTGGADAQGDIVA

SEQ ID NO: 2797 - protein, 14 aa, synthetic construct
  REGION 1..14: note = Synthetic
TNVTAVPASGAPAA

SEQ ID NO: 2798 - protein, 14 aa, synthetic construct
  REGION 1..14: note = Synthetic
TRAELGLGMAAALG

SEQ ID NO: 2799 - protein, 14 aa, synthetic construct
  REGION 1..14: note = Synthetic
TSSGQLSDDGIRRF

SEQ ID NO: 2800 - protein, 14 aa, synthetic construct
  REGION 1..14: note = Synthetic
TVHTNGIAHRTELR

SEQ ID NO: 2801 - protein, 14 aa, synthetic construct
  REGION 1..14: note = Synthetic
TYRYRLAANGNGQW

SEQ ID NO: 2802 - protein, 14 aa, synthetic construct
  REGION 1..14: note = Synthetic
VADHATLANVGDTW

SEQ ID NO: 2803 - protein, 14 aa, synthetic construct
  REGION 1..14: note = Synthetic
VHVGGYATYIADSG

SEQ ID NO: 2804 - protein, 9 aa, synthetic construct
  REGION 1..9: note = Synthetic
VLDGWYGVD

SEQ ID NO: 2805 - protein, 14 aa, synthetic construct
  REGION 1..14: note = Synthetic
VPASGAPAAVSVLG

SEQ ID NO: 2806 - protein, 14 aa, synthetic construct
  REGION 1..14: note = Synthetic
VRDEGGSSVLGRLG

SEQ ID NO: 2807 - protein, 14 aa, synthetic construct
  REGION 1..14: note = Synthetic
VRTASGTTIKVSGR

SEQ ID NO: 2808 - protein, 14 aa, synthetic construct
  REGION 1..14: note = Synthetic
VSGGSLSAPHGNVI

SEQ ID NO: 2809 - protein, 14 aa, synthetic construct
  REGION 1..14: note = Synthetic
VSGRQAQGILLENP

SEQ ID NO: 2810 - protein, 14 aa, synthetic construct
  REGION 1..14: note = Synthetic
VTVQRSAIVDGGLH

SEQ ID NO: 2811 - protein, 14 aa, synthetic construct
  REGION 1..14: note = Synthetic
VVLRDTNVTAVPAS

SEQ ID NO: 2812 - protein, 14 aa, synthetic construct
  REGION 1..14: note = Synthetic
WNNQSIVKTGERQH

SEQ ID NO: 2813 - protein, 14 aa, synthetic construct
  REGION 1..14: note = Synthetic
WVRNSGSEPASANT

SEQ ID NO: 2814 - protein, 14 aa, synthetic construct
  REGION 1..14: note = Synthetic
WYAESNALSKRLGE

SEQ ID NO: 2815 - protein, 14 aa, synthetic construct
  REGION 1..14: note = Synthetic
YATYIADSGFYLDA

SEQ ID NO: 2816 - protein, 9 aa, synthetic construct
  REGION 1..9: note = Synthetic
YGVDVSGSS

SEQ ID NO: 2817 - protein, 14 aa, synthetic construct
  REGION 1..14: note = Synthetic
YGVDVSGSSVELAQ

SEQ ID NO: 2818 - protein, 14 aa, synthetic construct
  REGION 1..14: note = Synthetic
YLDATLRASRLEND

SEQ ID NO: 2819 - protein, 14 aa, synthetic construct
  REGION 1..14: note = Synthetic
YRVLPEPVKLTLTG

SEQ ID NO: 2820 - protein, 16 aa, synthetic construct
  REGION 1..16: note = Synthetic
VKAQNITNKRAALIEA

SEQ ID NO: 2821 - protein, 16 aa, synthetic construct
  REGION 1..16: note = Synthetic
YYSNVTATRLLSSTNS

SEQ ID NO: 2822 - protein, 15 aa, synthetic construct
  REGION 1..15: note = Synthetic
SPNLTDERAAQAGVT

SEQ ID NO: 2823 - protein, 15 aa, synthetic construct
  REGION 1..15: note = Synthetic
SSRASDERAAHLPTS

SEQ ID NO: 2824 - protein, 15 aa, synthetic construct
  REGION 1..15: note = Synthetic
QVVHNSYNRPAYSPG

SEQ ID NO: 2825 - protein, 9 aa, synthetic construct
  REGION 1..9: note = Synthetic
AEGGEIHEL

SEQ ID NO: 2826 - protein, 12 aa, synthetic construct
  REGION 1..12: note = Synthetic
AENLISNGIGKY

SEQ ID NO: 2827 - protein, 9 aa, synthetic construct
  REGION 1..9: note = Synthetic
AEVDGDVKL

SEQ ID NO: 2828 - protein, 9 aa, synthetic construct
  REGION 1..9: note = Synthetic
AIYTAEIHK

SEQ ID NO: 2829 - protein, 9 aa, synthetic construct
  REGION 1..9: note = Synthetic
APVFHMTNY

SEQ ID NO: 2830 - protein, 16 aa, synthetic construct
  REGION 1..16: note = Synthetic
APVFHMTNYLEQPVSN

SEQ ID NO: 2831 - protein, 8 aa, synthetic construct
  REGION 1..8: note = Synthetic
AQRLNEIY

SEQ ID NO: 2832 - protein, 9 aa, synthetic construct
  REGION 1..9: note = Synthetic
ARVPHAYSL

SEQ ID NO: 2833 - protein, 9 aa, synthetic construct
  REGION 1..9: note = Synthetic
AVRDLERAM

SEQ ID NO: 2834 - protein, 13 aa, synthetic construct
  REGION 1..13: note = Synthetic
AVRDLERAMTTLK

SEQ ID NO: 2835 - protein, 9 aa, synthetic construct
  REGION 1..9: note = Synthetic
DALLRLQAM

SEQ ID NO: 2836 - protein, 9 aa, synthetic construct
  REGION 1..9: note = Synthetic
DIKEKVINL

SEQ ID NO: 2837 - protein, 8 aa, synthetic construct
  REGION 1..8: note = Synthetic
DQGLFKVL

SEQ ID NO: 2838 - protein, 9 aa, synthetic construct
  REGION 1..9: note = Synthetic
DTGVDTRIW

SEQ ID NO: 2839 - protein, 12 aa, synthetic construct
  REGION 1..12: note = Synthetic
EPIGSLAIEEAM

SEQ ID NO: 2840 - protein, 10 aa, synthetic construct
  REGION 1..10: note = Synthetic
EPIRDALNAM

SEQ ID NO: 2841 - protein, 8 aa, synthetic construct
  REGION 1..8: note = Synthetic
FPKLGKTL

SEQ ID NO: 2842 - protein, 9 aa, synthetic construct
  REGION 1..9: note = Synthetic
FRSVNAVAF

SEQ ID NO: 2843 - protein, 10 aa, synthetic construct
  REGION 1..10: note = Synthetic
GKIIDNTEQL

SEQ ID NO: 2844 - protein, 9 aa, synthetic construct
  REGION 1..9: note = Synthetic
GLNEKLVFY

SEQ ID NO: 2845 - protein, 11 aa, synthetic construct
  REGION 1..11: note = Synthetic
GMYGGTYLVEK

SEQ ID NO: 2846 - protein, 14 aa, synthetic construct
  REGION 1..14: note = Synthetic
GPPISLERLDVGTN

SEQ ID NO: 2847 - protein, 10 aa, synthetic construct
  REGION 1..10: note = Synthetic
GPRQAQVSFL

SEQ ID NO: 2848 - protein, 11 aa, synthetic construct
  REGION 1..11: note = Synthetic
GRLVPQVRVID

SEQ ID NO: 2849 - protein, 10 aa, synthetic construct
  REGION 1..10: note = Synthetic
GSAPISMGFR

SEQ ID NO: 2850 - protein, 9 aa, synthetic construct
  REGION 1..9: note = Synthetic
HILAKSTAL

SEQ ID NO: 2851 - protein, 9 aa, synthetic construct
  REGION 1..9: note = Synthetic
HYREVNLVY

SEQ ID NO: 2852 - protein, 9 aa, synthetic construct
  REGION 1..9: note = Synthetic
IPPMKNLAL

SEQ ID NO: 2853 - protein, 12 aa, synthetic construct
  REGION 1..12: note = Synthetic
IPYQGSGKGVSF

SEQ ID NO: 2854 - protein, 9 aa, synthetic construct
  REGION 1..9: note = Synthetic
ISKESQHVY

SEQ ID NO: 2855 - protein, 9 aa, synthetic construct
  REGION 1..9: note = Synthetic
IVSSHFFVY

SEQ ID NO: 2856 - protein, 10 aa, synthetic construct
  REGION 1..10: note = Synthetic
KEIKETGRLF

SEQ ID NO: 2857 - protein, 9 aa, synthetic construct
  REGION 1..9: note = Synthetic
KESQHVYYL

SEQ ID NO: 2858 - protein, 9 aa, synthetic construct
  REGION 1..9: note = Synthetic
KIIDNTEQL

SEQ ID NO: 2859 - protein, 8 aa, synthetic construct
  REGION 1..8: note = Synthetic
KKQINRQN

SEQ ID NO: 2860 - protein, 10 aa, synthetic construct
  REGION 1..10: note = Synthetic
KKVDTNFIYQ

SEQ ID NO: 2861 - protein, 9 aa, synthetic construct
  REGION 1..9: note = Synthetic
KLIDGFFPA

SEQ ID NO: 2862 - protein, 11 aa, synthetic construct
  REGION 1..11: note = Synthetic
KPNLSSKRSEL

SEQ ID NO: 2863 - protein, 9 aa, synthetic construct
  REGION 1..9: note = Synthetic
KVSPYLFTV

SEQ ID NO: 2864 - protein, 10 aa, synthetic construct
  REGION 1..10: note = Synthetic
LETRTTNQFL

SEQ ID NO: 2865 - protein, 8 aa, synthetic construct
  REGION 1..8: note = Synthetic
LLKEATEL

SEQ ID NO: 2866 - protein, 9 aa, synthetic construct
  REGION 1..9: note = Synthetic
LLKKGNSLY

SEQ ID NO: 2867 - protein, 10 aa, synthetic construct
  REGION 1..10: note = Synthetic
LPAPIGGMNY

SEQ ID NO: 2868 - protein, 10 aa, synthetic construct
  REGION 1..10: note = Synthetic
MPEETLHQVM

SEQ ID NO: 2869 - protein, 9 aa, synthetic construct
  REGION 1..9: note = Synthetic
PTTIRGQFS

SEQ ID NO: 2870 - protein, 11 aa, synthetic construct
  REGION 1..11: note = Synthetic
QEISRHQALGY

SEQ ID NO: 2871 - protein, 10 aa, synthetic construct
  REGION 1..10: note = Synthetic
RITHVDTESY

SEQ ID NO: 2872 - protein, 8 aa, synthetic construct
  REGION 1..8: note = Synthetic
RPGLKPDL

SEQ ID NO: 2873 - protein, 8 aa, synthetic construct
  REGION 1..8: note = Synthetic
RPIYGLEV

SEQ ID NO: 2874 - protein, 11 aa, synthetic construct
  REGION 1..11: note = Synthetic
RQAGQEMILAV

SEQ ID NO: 2875 - protein, 9 aa, synthetic construct
  REGION 1..9: note = Synthetic
SAVRIATVY

SEQ ID NO: 2876 - protein, 11 aa, synthetic construct
  REGION 1..11: note = Synthetic
SLMPEETLHQV

SEQ ID NO: 2877 - protein, 9 aa, synthetic construct
  REGION 1..9: note = Synthetic
SMIDLVTKF

SEQ ID NO: 2878 - protein, 13 aa, synthetic construct
  REGION 1..13: note = Synthetic
SMLNSQAIDNLRA

SEQ ID NO: 2879 - protein, 8 aa, synthetic construct
  REGION 1..8: note = Synthetic
SMYRVFEV

SEQ ID NO: 2880 - protein, 9 aa, synthetic construct
  REGION 1..9: note = Synthetic
SQQGMFHAY

SEQ ID NO: 2881 - protein, 14 aa, synthetic construct
  REGION 1..14: note = Synthetic
TDTPIVYNDRNLLD

SEQ ID NO: 2882 - protein, 12 aa, synthetic construct
  REGION 1..12: note = Synthetic
VIINDDQGLFKV

SEQ ID NO: 2883 - protein, 10 aa, synthetic construct
  REGION 1..10: note = Synthetic
YESGVRIASL

SEQ ID NO: 2884 - protein, 8 aa, synthetic construct
  REGION 1..8: note = Synthetic
YLKDKALA

SEQ ID NO: 2885 - protein, 11 aa, synthetic construct
  REGION 1..11: note = Synthetic
YVYDHSGEAVK

SEQ ID NO: 2886 - protein, 15 aa, synthetic construct
  REGION 1..15: note = Synthetic
ARVIDPAAQSFTGVV

SEQ ID NO: 2887 - protein, 15 aa, synthetic construct
  REGION 1..15: note = Synthetic
SDRASARVIDPAAQS

SEQ ID NO: 2888 - protein, 15 aa, synthetic construct
  REGION 1..15: note = Synthetic
VPPGKFVTAALLNTP

SEQ ID NO: 2889 - protein, 15 aa, synthetic construct
  REGION 1..15: note = Synthetic
WVTPVIGSQARKCGL

SEQ ID NO: 2890 - DNA, 20 bp, synthetic construct
  misc_feature 1..20: note = Synthetic
  source 1..20: mol_type = other DNA
ggcccagactgagcacgtga

SEQ ID NO: 2891 - DNA, 20 bp, synthetic construct
  misc_feature 1..20: note = Synthetic
  source 1..20: mol_type = other DNA
ggcccagactgagcacgtga

SEQ ID NO: 2892 - DNA, 20 bp, synthetic construct
  misc_feature 1..20: note = Synthetic
  source 1..20: mol_type = other DNA
ggcccagactgagcacgtga

SEQ ID NO: 2893 - DNA, 20 bp, synthetic construct
  misc_feature 1..20: note = Synthetic
  source 1..20: mol_type = other DNA
ggcccagactgagcacgtga

SEQ ID NO: 2894 - DNA, 20 bp, synthetic construct
  misc_feature 1..20: note = Synthetic
  source 1..20: mol_type = other DNA
ggcccagactgagcacgtga

SEQ ID NO: 2895 - DNA, 20 bp, synthetic construct
  misc_feature 1..20: note = Synthetic
  source 1..20: mol_type = other DNA
ggcccagactgagcacgtga

SEQ ID NO: 2896 - DNA, 20 bp, synthetic construct
  misc_feature 1..20: note = Synthetic
  source 1..20: mol_type = other DNA
ggcccagactgagcacgtga

SEQ ID NO: 2897 - DNA, 20 bp, synthetic construct
  misc_feature 1..20: note = Synthetic
  source 1..20: mol_type = other DNA
ggcccagactgagcacgtga

SEQ ID NO: 2898 - DNA, 20 bp, synthetic construct
  misc_feature 1..20: note = Synthetic
  source 1..20: mol_type = other DNA
ggcccagactgagcacgtga

SEQ ID NO: 2899 - DNA, 20 bp, synthetic construct
  misc_feature 1..20: note = Synthetic
  source 1..20: mol_type = other DNA
ggcccagactgagcacgtga

SEQ ID NO: 2900 - DNA, 20 bp, synthetic construct
  misc_feature 1..20: note = Synthetic
  source 1..20: mol_type = other DNA
gagtccgagcagaagaagaa

SEQ ID NO: 2901 - DNA, 20 bp, synthetic construct
  misc_feature 1..20: note = Synthetic
  source 1..20: mol_type = other DNA
gagtccgagcagaagaagaa

SEQ ID NO: 2902 - DNA, 20 bp, synthetic construct
  misc_feature 1..20: note = Synthetic
  source 1..20: mol_type = other DNA
gagtccgagcagaagaagaa

SEQ ID NO: 2903 - DNA, 20 bp, synthetic construct
  misc_feature 1..20: note = Synthetic
  source 1..20: mol_type = other DNA
gagtccgagcagaagaagaa

SEQ ID NO: 2904 - DNA, 20 bp, synthetic construct
  misc_feature 1..20: note = Synthetic
  source 1..20: mol_type = other DNA
gagtccgagcagaagaagaa

SEQ ID NO: 2905 - DNA, 20 bp, synthetic construct
  misc_feature 1..20: note = Synthetic
  source 1..20: mol_type = other DNA
gagtccgagcagaagaagaa

SEQ ID NO: 2906 - DNA, 20 bp, synthetic construct
  misc_feature 1..20: note = Synthetic
  source 1..20: mol_type = other DNA
gagtccgagcagaagaagaa

SEQ ID NO: 2907 - DNA, 20 bp, synthetic construct
  misc_feature 1..20: note = Synthetic
  source 1..20: mol_type = other DNA
gagtccgagcagaagaagaa

SEQ ID NO: 2908 - DNA, 20 bp, synthetic construct
  misc_feature 1..20: note = Synthetic
  source 1..20: mol_type = other DNA
gagtccgagcagaagaagaa

SEQ ID NO: 2909 - DNA, 20 bp, synthetic construct
  misc_feature 1..20: note = Synthetic
  source 1..20: mol_type = other DNA
ggaatcccttctgcagcacc

SEQ ID NO: 2910 - DNA, 20 bp, synthetic construct
  misc_feature 1..20: note = Synthetic
  source 1..20: mol_type = other DNA
ggaatcccttctgcagcacc

SEQ ID NO: 2911 - DNA, 20 bp, synthetic construct
  misc_feature 1..20: note = Synthetic
  source 1..20: mol_type = other DNA
ggaatcccttctgcagcacc

SEQ ID NO: 2912 - DNA, 20 bp, synthetic construct
  misc_feature 1..20: note = Synthetic
  source 1..20: mol_type = other DNA
ggaatcccttctgcagcacc

SEQ ID NO: 2913 - DNA, 20 bp, synthetic construct
  misc_feature 1..20: note = Synthetic
  source 1..20: mol_type = other DNA
ggaatcccttctgcagcacc

SEQ ID NO: 2914 - DNA, 20 bp, synthetic construct
  misc_feature 1..20: note = Synthetic
  source 1..20: mol_type = other DNA
ggaatcccttctgcagcacc

SEQ ID NO: 2915 - DNA, 20 bp, synthetic construct
  misc_feature 1..20: note = Synthetic
  source 1..20: mol_type = other DNA
ggaatcccttctgcagcacc

SEQ ID NO: 2916 - DNA, 20 bp, synthetic construct
  misc_feature 1..20: note = Synthetic
  source 1..20: mol_type = other DNA
ggaatcccttctgcagcacc

SEQ ID NO: 2917 - DNA, 20 bp, synthetic construct
  misc_feature 1..20: note = Synthetic
  source 1..20: mol_type = other DNA
ggaatcccttctgcagcacc

SEQ ID NO: 2918 - DNA, 20 bp, synthetic construct
  misc_feature 1..20: note = Synthetic
  source 1..20: mol_type = other DNA
ggaatcccttctgcagcacc

SEQ ID NO: 2919 - DNA, 20 bp, synthetic construct
  misc_feature 1..20: note = Synthetic
  source 1..20: mol_type = other DNA
gtcatcttagtcattacctg

SEQ ID NO: 2920 - DNA, 20 bp, synthetic construct
  misc_feature 1..20: note = Synthetic
  source 1..20: mol_type = other DNA
gtcatcttagtcattacctg

SEQ ID NO: 2921 - DNA, 20 bp, synthetic construct
  misc_feature 1..20: note = Synthetic
  source 1..20: mol_type = other DNA
gtcatcttagtcattacctg

SEQ ID NO: 2922 - DNA, 20 bp, synthetic construct
  misc_feature 1..20: note = Synthetic
  source 1..20: mol_type = other DNA
gtcatcttagtcattacctg

SEQ ID NO: 2923 - DNA, 20 bp, synthetic construct
  misc_feature 1..20: note = Synthetic
  source 1..20: mol_type = other DNA
gtcatcttagtcattacctg

SEQ ID NO: 2924 - DNA, 20 bp, synthetic construct
  misc_feature 1..20: note = Synthetic
  source 1..20: mol_type = other DNA
gtcatcttagtcattacctg

SEQ ID NO: 2925 - DNA, 20 bp, synthetic construct
  misc_feature 1..20: note = Synthetic
  source 1..20: mol_type = other DNA
gtcatcttagtcattacctg

SEQ ID NO: 2926 - DNA, 20 bp, synthetic construct
  misc_feature 1..20: note = Synthetic
  source 1..20: mol_type = other DNA
gtcatcttagtcattacctg

SEQ ID NO: 2927 - DNA, 20 bp, synthetic construct
  misc_feature 1..20: note = Synthetic
  source 1..20: mol_type = other DNA
gtcatcttagtcattacctg

SEQ ID NO: 2928 - DNA, 20 bp, synthetic construct
  misc_feature 1..20: note = Synthetic
  source 1..20: mol_type = other DNA
ggcactgcggctggaggtgg

SEQ ID NO: 2929 - DNA, 20 bp, synthetic construct
  misc_feature 1..20: note = Synthetic
  source 1..20: mol_type = other DNA
ggcactgcggctggaggtgg

SEQ ID NO: 2930 - DNA, 20 bp, synthetic construct
  misc_feature 1..20: note = Synthetic
  source 1..20: mol_type = other DNA
ggcactgcggctggaggtgg

SEQ ID NO: 2931 - DNA, 20 bp, synthetic construct
  misc_feature 1..20: note = Synthetic
  source 1..20: mol_type = other DNA
ggcactgcggctggaggtgg

SEQ ID NO: 2932 - DNA, 20 bp, synthetic construct
  misc_feature 1..20: note = Synthetic
  source 1..20: mol_type = other DNA
ggcactgcggctggaggtgg

SEQ ID NO: 2933 - DNA, 20 bp, synthetic construct
  misc_feature 1..20: note = Synthetic
  source 1..20: mol_type = other DNA
ggcactgcggctggaggtgg

SEQ ID NO: 2934 - DNA, 20 bp, synthetic construct
  misc_feature 1..20: note = Synthetic
  source 1..20: mol_type = other DNA
ggcactgcggctggaggtgg

SEQ ID NO: 2935 - DNA, 20 bp, synthetic construct
  misc_feature 1..20: note = Synthetic
  source 1..20: mol_type = other DNA
ggcactgcggctggaggtgg

SEQ ID NO: 2936 - DNA, 20 bp, synthetic construct
  misc_feature 1..20: note = Synthetic
  source 1..20: mol_type = other DNA
ggcactgcggctggaggtgg

SEQ ID NO: 2937 - DNA, 20 bp, synthetic construct
  misc_feature 1..20: note = Synthetic
  source 1..20: mol_type = other DNA
ggcccagactgagcacgtga

SEQ ID NO: 2938 - DNA, 20 bp, synthetic construct
  misc_feature 1..20: note = Synthetic
  source 1..20: mol_type = other DNA
ggcccagactgagcacgtga

SEQ ID NO: 2939 - DNA, 20 bp, synthetic construct
  misc_feature 1..20: note = Synthetic
  source 1..20: mol_type = other DNA
ggcccagactgagcacgtga

SEQ ID NO: 2940 - DNA, 20 bp, synthetic construct
  misc_feature 1..20: note = Synthetic
  source 1..20: mol_type = other DNA
ggcccagactgagcacgtga

SEQ ID NO: 2941 - DNA, 20 bp, synthetic construct
  misc_feature 1..20: note = Synthetic
  source 1..20: mol_type = other DNA
ggcccagactgagcacgtga

SEQ ID NO: 2942 - DNA, 20 bp, synthetic construct
  misc_feature 1..20: note = Synthetic
  source 1..20: mol_type = other DNA
ggcccagactgagcacgtga

SEQ ID NO: 2943 - DNA, 20 bp, synthetic construct
  misc_feature 1..20: note = Synthetic
  source 1..20: mol_type = other DNA
ggcccagactgagcacgtga

SEQ ID NO: 2944 - DNA, 20 bp, synthetic construct
  misc_feature 1..20: note = Synthetic
  source 1..20: mol_type = other DNA
ggcccagactgagcacgtga

SEQ ID NO: 2945 - DNA, 20 bp, synthetic construct
  misc_feature 1..20: note = Synthetic
  source 1..20: mol_type = other DNA
ggcccagactgagcacgtga

SEQ ID NO: 2946 - DNA, 20 bp, synthetic construct
  misc_feature 1..20: note = Synthetic
  source 1..20: mol_type = other DNA
ggcccagactgagcacgtga

SEQ ID NO: 2947 - DNA, 20 bp, synthetic construct
  misc_feature 1..20: note = Synthetic
  source 1..20: mol_type = other DNA
ggcccagactgagcacgtga

SEQ ID NO: 2948 - DNA, 20 bp, synthetic construct
  misc_feature 1..20: note = Synthetic
  source 1..20: mol_type = other DNA
ggcccagactgagcacgtga

SEQ ID NO: 2949 - DNA, 20 bp, synthetic construct
  misc_feature 1..20: note = Synthetic
  source 1..20: mol_type = other DNA
ggcccagactgagcacgtga

SEQ ID NO: 2950 - DNA, 20 bp, synthetic construct
  misc_feature 1..20: note = Synthetic
  source 1..20: mol_type = other DNA
ggcccagactgagcacgtga

SEQ ID NO: 2951 - DNA, 20 bp, synthetic construct
  misc_feature 1..20: note = Synthetic
  source 1..20: mol_type = other DNA
gagtccgagcagaagaagaa

SEQ ID NO: 2952 - DNA, 20 bp, synthetic construct
  misc_feature 1..20: note = Synthetic
  source 1..20: mol_type = other DNA
gagtccgagcagaagaagaa

SEQ ID NO: 2953 - DNA, 20 bp, synthetic construct
  misc_feature 1..20: note = Synthetic
  source 1..20: mol_type = other DNA
gagtccgagcagaagaagaa

SEQ ID NO: 2954 - DNA, 20 bp, synthetic construct
  misc_feature 1..20: note = Synthetic
  source 1..20: mol_type = other DNA
gagtccgagcagaagaagaa

SEQ ID NO: 2955 - DNA, 20 bp, synthetic construct
  misc_feature 1..20: note = Synthetic
  source 1..20: mol_type = other DNA
gagtccgagcagaagaagaa

SEQ ID NO: 2956 - DNA, 20 bp, synthetic construct
  misc_feature 1..20: note = Synthetic
  source 1..20: mol_type = other DNA
gagtccgagcagaagaagaa

SEQ ID NO: 2957 - DNA, 20 bp, synthetic construct
  misc_feature 1..20: note = Synthetic
  source 1..20: mol_type = other DNA
gagtccgagcagaagaagaa

SEQ ID NO: 2958 - DNA, 20 bp, synthetic construct
  misc_feature 1..20: note = Synthetic
  source 1..20: mol_type = other DNA
gagtccgagcagaagaagaa

SEQ ID NO: 2959 - DNA, 20 bp, synthetic construct
  misc_feature 1..20: note = Synthetic
  source 1..20: mol_type = other DNA
gagtccgagcagaagaagaa

SEQ ID NO: 2960 - DNA, 20 bp, synthetic construct
  misc_feature 1..20: note = Synthetic
  source 1..20: mol_type = other DNA
gagtccgagcagaagaagaa

SEQ ID NO: 2961 - DNA, 20 bp, synthetic construct
  misc_feature 1..20: note = Synthetic
  source 1..20: mol_type = other DNA
gagtccgagcagaagaagaa

SEQ ID NO: 2962 - DNA, 20 bp, synthetic construct
  misc_feature 1..20: note = Synthetic
  source 1..20: mol_type = other DNA
ggaatcccttctgcagcacc

SEQ ID NO: 2963 - DNA, 20 bp, synthetic construct
  misc_feature 1..20: note = Synthetic
  source 1..20: mol_type = other DNA
ggaatcccttctgcagcacc

SEQ ID NO: 2964 - DNA, 20 bp, synthetic construct
  misc_feature 1..20: note = Synthetic
  source 1..20: mol_type = other DNA
ggaatcccttctgcagcacc

SEQ ID NO: 2965 - DNA, 20 bp, synthetic construct
  misc_feature 1..20: note = Synthetic
  source 1..20: mol_type = other DNA
ggaatcccttctgcagcacc

SEQ ID NO: 2966 - DNA, 20 bp, synthetic construct
  misc_feature 1..20: note = Synthetic
  source 1..20: mol_type = other DNA
ggaatcccttctgcagcacc

SEQ ID NO: 2967 - DNA, 20 bp, synthetic construct
  misc_feature 1..20: note = Synthetic
  source 1..20: mol_type = other DNA
ggaatcccttctgcagcacc

SEQ ID NO: 2968 - DNA, 20 bp, synthetic construct
  misc_feature 1..20: note = Synthetic
  source 1..20: mol_type = other DNA
ggaatcccttctgcagcacc

SEQ ID NO: 2969 - DNA, 20 bp, synthetic construct
  misc_feature 1..20: note = Synthetic
  source 1..20: mol_type = other DNA
ggaatcccttctgcagcacc

SEQ ID NO: 2970 - DNA, 20 bp, synthetic construct
  misc_feature 1..20: note = Synthetic
  source 1..20: mol_type = other DNA
ggaatcccttctgcagcacc

SEQ ID NO: 2971 - DNA, 20 bp, synthetic construct
  misc_feature 1..20: note = Synthetic
  source 1..20: mol_type = other DNA
ggaatcccttctgcagcacc

SEQ ID NO: 2972 - DNA, 20 bp, synthetic construct
  misc_feature 1..20: note = Synthetic
  source 1..20: mol_type = other DNA
ggaatcccttctgcagcacc

SEQ ID NO: 2973 - DNA, 20 bp, synthetic construct
  misc_feature 1..20: note = Synthetic
  source 1..20: mol_type = other DNA
gtcatcttagtcattacctg

SEQ ID NO: 2974 - DNA, 20 bp, synthetic construct
  misc_feature 1..20: note = Synthetic
  source 1..20: mol_type = other DNA
gtcatcttagtcattacctg

SEQ ID NO: 2975 - DNA, 20 bp, synthetic construct
  misc_feature 1..20: note = Synthetic
  source 1..20: mol_type = other DNA
gtcatcttagtcattacctg

SEQ ID NO: 2976 - DNA, 20 bp, synthetic construct
  misc_feature 1..20: note = Synthetic
  source 1..20: mol_type = other DNA
gtcatcttagtcattacctg

SEQ ID NO: 2977 - DNA, 20 bp, synthetic construct
  misc_feature 1..20: note = Synthetic
  source 1..20: mol_type = other DNA
gtcatcttagtcattacctg

SEQ ID NO: 2978 - DNA, 20 bp, synthetic construct
  misc_feature 1..20: note = Synthetic
  source 1..20: mol_type = other DNA
gtcatcttagtcattacctg

SEQ ID NO: 2979 - DNA, 20 bp, synthetic construct
  misc_feature 1..20: note = Synthetic
  source 1..20: mol_type = other DNA
gtcatcttagtcattacctg

SEQ ID NO: 2980 - DNA, 20 bp, synthetic construct
  misc_feature 1..20: note = Synthetic
  source 1..20: mol_type = other DNA
gtcatcttagtcattacctg

SEQ ID NO: 2981 - DNA, 20 bp, synthetic construct
  misc_feature 1..20: note = Synthetic
  source 1..20: mol_type = other DNA
gtcatcttagtcattacctg

SEQ ID NO: 2982 - DNA, 20 bp, synthetic construct
  misc_feature 1..20: note = Synthetic
  source 1..20: mol_type = other DNA
gtcatcttagtcattacctg

SEQ ID NO: 2983 - DNA, 20 bp, synthetic construct
  misc_feature 1..20: note = Synthetic
  source 1..20: mol_type = other DNA
gtcatcttagtcattacctg

SEQ ID NO: 2984 - DNA, 20 bp, synthetic construct
  misc_feature 1..20: note = Synthetic
  source 1..20: mol_type = other DNA
ggcactgcggctggaggtgg

SEQ ID NO: 2985 - DNA, 20 bp, synthetic construct
  misc_feature 1..20: note = Synthetic
  source 1..20: mol_type = other DNA
ggcactgcggctggaggtgg

SEQ ID NO: 2986 - DNA, 20 bp, synthetic construct
  misc_feature 1..20: note = Synthetic
  source 1..20: mol_type = other DNA
ggcactgcggctggaggtgg

SEQ ID NO: 2987 - DNA, 20 bp, synthetic construct
  misc_feature 1..20: note = Synthetic
  source 1..20: mol_type = other DNA
ggcactgcggctggaggtgg

SEQ ID NO: 2988 - DNA, 20 bp, synthetic construct
  misc_feature 1..20: note = Synthetic
  source 1..20: mol_type = other DNA
ggcactgcggctggaggtgg

SEQ ID NO: 2989 - DNA, 20 bp, synthetic construct
  misc_feature 1..20: note = Synthetic
  source 1..20: mol_type = other DNA
ggcactgcggctggaggtgg

SEQ ID NO: 2990 - DNA, 20 bp, synthetic construct
  misc_feature 1..20: note = Synthetic
  source 1..20: mol_type = other DNA
ggcactgcggctggaggtgg

SEQ ID NO: 2991 - DNA, 20 bp, synthetic construct
  misc_feature 1..20: note = Synthetic
  source 1..20: mol_type = other DNA
ggcactgcggctggaggtgg

SEQ ID NO: 2992 - DNA, 20 bp, synthetic construct
  misc_feature 1..20: note = Synthetic
  source 1..20: mol_type = other DNA
ggcactgcggctggaggtgg

SEQ ID NO: 2993 - DNA, 20 bp, synthetic construct
  misc_feature 1..20: note = Synthetic
  source 1..20: mol_type = other DNA
ggcactgcggctggaggtgg

SEQ ID NO: 2994 - DNA, 20 bp, synthetic construct
  misc_feature 1..20: note = Synthetic
  source 1..20: mol_type = other DNA
ggcactgcggctggaggtgg

SEQ ID NO: 2995 - DNA, 20 bp, synthetic construct
  misc_feature 1..20: note = Synthetic
  source 1..20: mol_type = other DNA
ggcactgcggctggaggtgg

SEQ ID NO: 2996 - DNA, 20 bp, synthetic construct
  misc_feature 1..20: note = Synthetic
  source 1..20: mol_type = other DNA
ggcactgcggctggaggtgg

SEQ ID NO: 2997 - DNA, 18 bp, synthetic construct
  misc_feature 1..18: note = Synthetic
  source 1..18: mol_type = other DNA
tctgccatctcgtgctca

SEQ ID NO: 2998 - DNA, 19 bp, synthetic construct
  misc_feature 1..19: note = Synthetic
  source 1..19: mol_type = other DNA
tctgccatctcgtgctcag

SEQ ID NO: 2999 - DNA, 20 bp, synthetic construct
  misc_feature 1..20: note = Synthetic
  source 1..20: mol_type = other DNA
tctgccatctcgtgctcagt

SEQ ID NO: 3000 - DNA, 21 bp, synthetic construct
  misc_feature 1..21: note = Synthetic
  source 1..21: mol_type = other DNA
tctgccatctcgtgctcagtc

SEQ ID NO: 3001 - DNA, 22 bp, synthetic construct
  misc_feature 1..22: note = Synthetic
  source 1..22: mol_type = other DNA
tctgccatctcgtgctcagtct

SEQ ID NO: 3002 - DNA, 23 bp, synthetic construct
  misc_feature 1..23: note = Synthetic
  source 1..23: mol_type = other DNA
tctgccatctcgtgctcagtctg

SEQ ID NO: 3003 - DNA, 24 bp, synthetic construct
  misc_feature 1..24: note = Synthetic
  source 1..24: mol_type = other DNA
tctgccatctcgtgctcagtctgg

SEQ ID NO: 3004 - DNA, 25 bp, synthetic construct
  misc_feature 1..25: note = Synthetic
  source 1..25: mol_type = other DNA
tctgccatctcgtgctcagtctggg

SEQ ID NO: 3005 - DNA, 26 bp, synthetic construct
  misc_feature 1..26: note = Synthetic
  source 1..26: mol_type = other DNA
tctgccatctcgtgctcagtctgggc

SEQ ID NO: 3006 - DNA, 27 bp, synthetic construct
  misc_feature 1..27: note = Synthetic
  source 1..27: mol_type = other DNA
tctgccatctcgtgctcagtctgggcc

SEQ ID NO: 3007 - DNA, 22 bp, synthetic construct
  misc_feature 1..22: note = Synthetic
  source 1..22: mol_type = other DNA
atgggagcacttcttcttctgc

SEQ ID NO: 3008 - DNA, 23 bp, synthetic construct
  misc_feature 1..23: note = Synthetic
  source 1..23: mol_type = other DNA
atgggagcacttcttcttctgct

SEQ ID NO: 3009 - DNA, 24 bp, synthetic construct
  misc_feature 1..24: note = Synthetic
  source 1..24: mol_type = other DNA
atgggagcacttcttcttctgctc

SEQ ID NO: 3010 - DNA, 25 bp, synthetic construct
  misc_feature 1..25: note = Synthetic
  source 1..25: mol_type = other DNA
atgggagcacttcttcttctgctcg

SEQ ID NO: 3011 - DNA, 26 bp, synthetic construct
  misc_feature 1..26: note = Synthetic
  source 1..26: mol_type = other DNA
atgggagcacttcttcttctgctcgg

SEQ ID NO: 3012 - DNA, 27 bp, synthetic construct
  misc_feature 1..27: note = Synthetic
  source 1..27: mol_type = other DNA
atgggagcacttcttcttctgctcgga

SEQ ID NO: 3013 - DNA, 28 bp, synthetic construct
  misc_feature 1..28: note = Synthetic
  source 1..28: mol_type = other DNA
atgggagcacttcttcttctgctcggac

SEQ ID NO: 3014 - DNA, 29 bp, synthetic construct
  misc_feature 1..29: note = Synthetic
  source 1..29: mol_type = other DNA
atgggagcacttcttcttctgctcggact

SEQ ID NO: 3015 - DNA, 30 bp, synthetic construct
  misc_feature 1..30: note = Synthetic
  source 1..30: mol_type = other DNA
atgggagcacttcttcttctgctcggactc

SEQ ID NO: 3016 - DNA, 25 bp, synthetic construct
  misc_feature 1..25: note = Synthetic
  source 1..25: mol_type = other DNA
ggaaaagcgatcaaggtgctgcaga

SEQ ID NO: 3017 - DNA, 26 bp, synthetic construct
  misc_feature 1..26: note = Synthetic
  source 1..26: mol_type = other DNA
ggaaaagcgatcaaggtgctgcagaa

SEQ ID NO: 3018 - DNA, 27 bp, synthetic construct
  misc_feature 1..27: note = Synthetic
  source 1..27: mol_type = other DNA
ggaaaagcgatcaaggtgctgcagaag

SEQ ID NO: 3019 - DNA, 28 bp, synthetic construct
  misc_feature 1..28: note = Synthetic
  source 1..28: mol_type = other DNA
ggaaaagcgatcaaggtgctgcagaagg

SEQ ID NO: 3020 - DNA, 29 bp, synthetic construct
  misc_feature 1..29: note = Synthetic
  source 1..29: mol_type = other DNA
ggaaaagcgatcaaggtgctgcagaaggg

SEQ ID NO: 3021 - DNA, 30 bp, synthetic construct
  misc_feature 1..30: note = Synthetic
  source 1..30: mol_type = other DNA
ggaaaagcgatcaaggtgctgcagaaggga

SEQ ID NO: 3022 - DNA, 31 bp, synthetic construct
  misc_feature 1..31: note = Synthetic
  source 1..31: mol_type = other DNA
ggaaaagcgatcaaggtgctgcagaagggat

SEQ ID NO: 3023 - DNA, 32 bp, synthetic construct
  misc_feature 1..32: note = Synthetic
  source 1..32: mol_type = other DNA
ggaaaagcgatcaaggtgctgcagaagggatt

SEQ ID NO: 3024 - DNA, 33 bp, synthetic construct
  misc_feature 1..33: note = Synthetic
  source 1..33: mol_type = other DNA
ggaaaagcgatcaaggtgctgcagaagggattc

SEQ ID NO: 3025 - DNA, 34 bp, synthetic construct
  misc_feature 1..34: note = Synthetic
  source 1..34: mol_type = other DNA
ggaaaagcgatcaaggtgctgcagaagggattcc

SEQ ID NO: 3026 - DNA, 20 bp, synthetic construct
  misc_feature 1..20: note = Synthetic
  source 1..20: mol_type = other DNA
gaacacctcatgtaatgact

SEQ ID NO: 3027 - DNA, 21 bp, synthetic construct
  misc_feature 1..21: note = Synthetic
  source 1..21: mol_type = other DNA
gaacacctcatgtaatgacta

SEQ ID NO: 3028 - DNA, 22 bp, synthetic construct
  misc_feature 1..22: note = Synthetic
  source 1..22: mol_type = other DNA
gaacacctcatgtaatgactaa

SEQ ID NO: 3029 - DNA, 23 bp, synthetic construct
  misc_feature 1..23: note = Synthetic
  source 1..23: mol_type = other DNA
gaacacctcatgtaatgactaag

SEQ ID NO: 3030 - DNA, 24 bp, synthetic construct
  misc_feature 1..24: note = Synthetic
  source 1..24: mol_type = other DNA
gaacacctcatgtaatgactaaga

SEQ ID NO: 3031 - DNA, 25 bp, synthetic construct
  misc_feature 1..25: note = Synthetic
  source 1..25: mol_type = other DNA
gaacacctcatgtaatgactaagat

SEQ ID NO: 3032 - DNA, 26 bp, synthetic construct
  misc_feature 1..26: note = Synthetic
  source 1..26: mol_type = other DNA
gaacacctcatgtaatgactaagatg

SEQ ID NO: 3033 - DNA, 27 bp, synthetic construct
  misc_feature 1..27: note = Synthetic
  source 1..27: mol_type = other DNA
gaacacctcatgtaatgactaagatga

SEQ ID NO: 3034 - DNA, 28 bp, synthetic construct
  misc_feature 1..28: note = Synthetic
  source 1..28: mol_type = other DNA
gaacacctcatgtaatgactaagatgac

SEQ ID NO: 3035 - DNA, 20 bp, synthetic construct
  misc_feature 1..20: note = Synthetic
  source 1..20: mol_type = other DNA
gctttaaccccaacctccag

SEQ ID NO: 3036 - DNA, 21 bp, synthetic construct
  misc_feature 1..21: note = Synthetic
  source 1..21: mol_type = other DNA
gctttaaccccaacctccagc

SEQ ID NO: 3037 - DNA, 22 bp, synthetic construct
  misc_feature 1..22: note = Synthetic
  source 1..22: mol_type = other DNA
gctttaaccccaacctccagcc

SEQ ID NO: 3038 - DNA, 23 bp, synthetic construct
  misc_feature 1..23: note = Synthetic
  source 1..23: mol_type = other DNA
gctttaaccccaacctccagccg

SEQ ID NO: 3039 - DNA, 24 bp, synthetic construct
  misc_feature 1..24: note = Synthetic
  source 1..24: mol_type = other DNA
gctttaaccccaacctccagccgc

SEQ ID NO: 3040 - DNA, 25 bp, synthetic construct
  misc_feature 1..25: note = Synthetic
  source 1..25: mol_type = other DNA
gctttaaccccaacctccagccgca

SEQ ID NO: 3041 - DNA, 26 bp, synthetic construct
  misc_feature 1..26: note = Synthetic
  source 1..26: mol_type = other DNA
gctttaaccccaacctccagccgcag

SEQ ID NO: 3042 - DNA, 27 bp, synthetic construct
  misc_feature 1..27: note = Synthetic
  source 1..27: mol_type = other DNA
gctttaaccccaacctccagccgcagt

SEQ ID NO: 3043 - DNA, 28 bp, synthetic construct
  misc_feature 1..28: note = Synthetic
  source 1..28: mol_type = other DNA
gctttaaccccaacctccagccgcagtg

SEQ ID NO: 3044 - DNA, 22 bp, synthetic construct
  misc_feature 1..22: note = Synthetic
  source 1..22: mol_type = other DNA
tctgccatccgtgctcagtctg

SEQ ID NO: 3045 - DNA, 24 bp, synthetic construct
  misc_feature 1..24: note = Synthetic
  source 1..24: mol_type = other DNA
tctgccatcatcgtgctcagtctg

SEQ ID NO: 3046 - DNA, 26 bp, synthetic construct
  misc_feature 1..26: note = Synthetic
  source 1..26: mol_type = other DNA
tctgccatcaaagcgtgctcagtctg

SEQ ID NO: 3047 - DNA, 23 bp, synthetic construct
  misc_feature 1..23: note = Synthetic
  source 1..23: mol_type = other DNA
tctgccatctcgtgctcagtctg

SEQ ID NO: 3048 - DNA, 24 bp, synthetic construct
  misc_feature 1..24: note = Synthetic
  source 1..24: mol_type = other DNA
ctctgccatctcgtgctcagtctg

SEQ ID NO: 3049 - DNA, 25 bp, synthetic construct
  misc_feature 1..25: note = Synthetic
  source 1..25: mol_type = other DNA
cctctgccatctcgtgctcagtctg

SEQ ID NO: 3050 - DNA, 26 bp, synthetic construct
  misc_feature 1..26: note = Synthetic
  source 1..26: mol_type = other DNA
tcctctgccatctcgtgctcagtctg

SEQ ID NO: 3051 - DNA, 27 bp, synthetic construct
  misc_feature 1..27: note = Synthetic
  source 1..27: mol_type = other DNA
ttcctctgccatctcgtgctcagtctg

SEQ ID NO: 3052 - DNA, 28 bp, synthetic construct
  misc_feature 1..28: note = Synthetic
  source 1..28: mol_type = other DNA
tttcctctgccatctcgtgctcagtctg

SEQ ID NO: 3053 - DNA, 29 bp, synthetic construct
  misc_feature 1..29: note = Synthetic
  source 1..29: mol_type = other DNA
ctttcctctgccatctcgtgctcagtctg

SEQ ID NO: 3054 - DNA, 30 bp, synthetic construct
  misc_feature 1..30: note = Synthetic
  source 1..30: mol_type = other DNA
cctttcctctgccatctcgtgctcagtctg

SEQ ID NO: 3055 - DNA, 31 bp, synthetic construct
  misc_feature 1..31: note = Synthetic
  source 1..31: mol_type = other DNA
tcctttcctctgccatctcgtgctcagtctg

SEQ ID NO: 3056 - DNA, 32 bp, synthetic construct
  misc_feature 1..32: note = Synthetic
  source 1..32: mol_type = other DNA
ttcctttcctctgccatctcgtgctcagtctg

SEQ ID NO: 3057 - DNA, 33 bp, synthetic construct
  misc_feature 1..33: note = Synthetic
  source 1..33: mol_type = other DNA
cttcctttcctctgccatctcgtgctcagtctg

SEQ ID NO: 3058 - DNA, 23 bp, synthetic construct
  misc_feature 1..23: note = Synthetic
  source 1..23: mol_type = other DNA
ggagcccttgttcttctgctcgg

SEQ ID NO: 3059 - DNA, 24 bp, synthetic construct
  misc_feature 1..24: note = Synthetic
  source 1..24: mol_type = other DNA
gggagcccttgttcttctgctcgg

SEQ ID NO: 3060 - DNA, 25 bp, synthetic construct
  misc_feature 1..25: note = Synthetic
  source 1..25: mol_type = other DNA
tgggagcccttgttcttctgctcgg

SEQ ID NO: 3061 - DNA, 26 bp, synthetic construct
  misc_feature 1..26: note = Synthetic
  source 1..26: mol_type = other DNA
atgggagcccttgttcttctgctcgg

SEQ ID NO: 3062 - DNA, 27 bp, synthetic construct
  misc_feature 1..27: note = Synthetic
  source 1..27: mol_type = other DNA
gatgggagcccttgttcttctgctcgg

SEQ ID NO: 3063 - DNA, 28 bp, synthetic construct
  misc_feature 1..28: note = Synthetic
  source 1..28: mol_type = other DNA
tgatgggagcccttgttcttctgctcgg

SEQ ID NO: 3064 - DNA, 29 bp, synthetic construct
  misc_feature 1..29: note = Synthetic
  source 1..29: mol_type = other DNA
gtgatgggagcccttgttcttctgctcgg

SEQ ID NO: 3065 - DNA, 30 bp, synthetic construct
  misc_feature 1..30: note = Synthetic
  source 1..30: mol_type = other DNA
tgtgatgggagcccttgttcttctgctcgg

SEQ ID NO: 3066 - DNA, 31 bp, synthetic construct
  misc_feature 1..31: note = Synthetic
  source 1..31: mol_type = other DNA
atgtgatgggagcccttgttcttctgctcgg

SEQ ID NO: 3067 - DNA, 32 bp, synthetic construct
  misc_feature 1..32: note = Synthetic
  source 1..32: mol_type = other DNA
gatgtgatgggagcccttgttcttctgctcgg

SEQ ID NO: 3068 - DNA, 33 bp, synthetic construct
  misc_feature 1..33: note = Synthetic
  source 1..33: mol_type = other DNA
tgatgtgatgggagcccttgttcttctgctcgg

SEQ ID NO: 3069 - DNA, 23 bp, synthetic construct
  misc_feature 1..23: note = Synthetic
  source 1..23: mol_type = other DNA
cgatcaaggtgctgcagaaggga

SEQ ID NO: 3070 - DNA, 24 bp, synthetic construct
  misc_feature 1..24: note = Synthetic
  source 1..24: mol_type = other DNA
gcgatcaaggtgctgcagaaggga

SEQ ID NO: 3071 - DNA, 25 bp, synthetic construct
  misc_feature 1..25: note = Synthetic
  source 1..25: mol_type = other DNA
agcgatcaaggtgctgcagaaggga

SEQ ID NO: 3072 - DNA, 26 bp, synthetic construct
  misc_feature 1..26: note = Synthetic
  source 1..26: mol_type = other DNA
aagcgatcaaggtgctgcagaaggga

SEQ ID NO: 3073 - DNA, 27 bp, synthetic construct
  misc_feature 1..27: note = Synthetic
  source 1..27: mol_type = other DNA
aaagcgatcaaggtgctgcagaaggga

SEQ ID NO: 3074 - DNA, 28 bp, synthetic construct
  misc_feature 1..28: note = Synthetic
  source 1..28: mol_type = other DNA
aaaagcgatcaaggtgctgcagaaggga

SEQ ID NO: 3075 - DNA, 29 bp, synthetic construct
  misc_feature 1..29: note = Synthetic
  source 1..29: mol_type = other DNA
gaaaagcgatcaaggtgctgcagaaggga

SEQ ID NO: 3076 - DNA, 30 bp, synthetic construct; identical to SEQ ID NO: 3021
  misc_feature 1..30: note = Synthetic
  source 1..30: mol_type = other DNA

SEQ ID NO: 3077 - DNA, 31 bp, synthetic construct
  misc_feature 1..31: note = Synthetic
  source 1..31: mol_type = other DNA
cggaaaagcgatcaaggtgctgcagaaggga

SEQ ID NO: 3078 - DNA, 32 bp, synthetic construct
  misc_feature 1..32: note = Synthetic
  source 1..32: mol_type = other DNA
tcggaaaagcgatcaaggtgctgcagaaggga

SEQ ID NO: 3079 - DNA, 33 bp, synthetic construct
  misc_feature 1..33: note = Synthetic
  source 1..33: mol_type = other DNA
ctcggaaaagcgatcaaggtgctgcagaaggga

SEQ ID NO: 3080 - DNA, 25 bp, synthetic construct
  misc_feature 1..25: note = Synthetic
  source 1..25: mol_type = other DNA
aacacctcatgtaatgactaagatg

SEQ ID NO: 3081 - DNA, 26 bp, synthetic construct
  misc_feature 1..26: note = Synthetic
  source 1..26: mol_type = other DNA
gaacacctcatgtaatgactaagatg

SEQ ID NO: 3082 - DNA, 27 bp, synthetic construct
  misc_feature 1..27: note = Synthetic
  source 1..27: mol_type = other DNA
cgaacacctcatgtaatgactaagatg

SEQ ID NO: 3083 - DNA, 28 bp, synthetic construct
  misc_feature 1..28: note = Synthetic
  source 1..28: mol_type = other DNA
acgaacacctcatgtaatgactaagatg

SEQ ID NO: 3084 - DNA, 29 bp, synthetic construct
  misc_feature 1..29: note = Synthetic
  source 1..29: mol_type = other DNA
aacgaacacctcatgtaatgactaagatg

SEQ ID NO: 3085 - DNA, 30 bp, synthetic construct
  misc_feature 1..30: note = Synthetic
  source 1..30: mol_type = other DNA
caacgaacacctcatgtaatgactaagatg

SEQ ID NO: 3086 - DNA, 31 bp, synthetic construct
  misc_feature 1..31: note = Synthetic
  source 1..31: mol_type = other DNA
acaacgaacacctcatgtaatgactaagatg

SEQ ID NO: 3087 - DNA, 32 bp, synthetic construct
  misc_feature 1..32: note = Synthetic
  source 1..32: mol_type = other DNA
tacaacgaacacctcatgtaatgactaagatg

SEQ ID NO: 3088 - DNA, 33 bp, synthetic construct
  misc_feature 1..33: note = Synthetic
  source 1..33: mol_type = other DNA
ttacaacgaacacctcatgtaatgactaagatg

SEQ ID NO: 3089 - DNA, 34 bp, synthetic construct
  misc_feature 1..34: note = Synthetic
  source 1..34: mol_type = other DNA
gttacaacgaacacctcatgtaatgactaagatg

SEQ ID NO: 3090 - DNA, 35 bp, synthetic construct
  misc_feature 1..35: note = Synthetic
  source 1..35: mol_type = other DNA
agttacaacgaacacctcatgtaatgactaagatg

SEQ ID NO: 3091 - DNA, 18 bp, synthetic construct
  misc_feature 1..18: note = Synthetic
  source 1..18: mol_type = other DNA
accccaacctccagccgc

SEQ ID NO: 3092 - DNA, 19 bp, synthetic construct
  misc_feature 1..19: note = Synthetic
  source 1..19: mol_type = other DNA
aaccccaacctccagccgc

SEQ ID NO: 3093 - DNA, 20 bp, synthetic construct
  misc_feature 1..20: note = Synthetic
  source 1..20: mol_type = other DNA
taaccccaacctccagccgc

SEQ ID NO: 3094 - DNA, 21 bp, synthetic construct
  misc_feature 1..21: note = Synthetic
  source 1..21: mol_type = other DNA
ttaaccccaacctccagccgc

SEQ ID NO: 3095 - DNA, 22 bp, synthetic construct
  misc_feature 1..22: note = Synthetic
  source 1..22: mol_type = other DNA
tttaaccccaacctccagccgc

SEQ ID NO: 3096 - DNA, 23 bp, synthetic construct
  misc_feature 1..23: note = Synthetic
  source 1..23: mol_type = other DNA
ctttaaccccaacctccagccgc

SEQ ID NO: 3097 - DNA, 24 bp, synthetic construct
  misc_feature 1..24: note = Synthetic
  source 1..24: mol_type = other DNA
gctttaaccccaacctccagccgc

SEQ ID NO: 3098 - DNA, 25 bp, synthetic construct
  misc_feature 1..25: note = Synthetic
  source 1..25: mol_type = other DNA
cgctttaaccccaacctccagccgc

SEQ ID NO: 3099 - DNA, 26 bp, synthetic construct
  misc_feature 1..26: note = Synthetic
  source 1..26: mol_type = other DNA
ccgctttaaccccaacctccagccgc

SEQ ID NO: 3100 - DNA, 27 bp, synthetic construct
  misc_feature 1..27: note = Synthetic
  source 1..27: mol_type = other DNA
tccgctttaaccccaacctccagccgc

SEQ ID NO: 3101 - DNA, 28 bp, synthetic construct
  misc_feature 1..28: note = Synthetic
  source 1..28: mol_type = other DNA
ctccgctttaaccccaacctccagccgc

SEQ ID NO: 3102 - DNA, 28 bp, synthetic construct
  misc_feature 1..28: note = Synthetic
  source 1..28: mol_type = other DNA
ctccgctttaaccccaacctccagccgc

SEQ ID NO: 3103 - DNA, 28 bp, synthetic construct
  misc_feature 1..28: note = Synthetic
  source 1..28: mol_type = other DNA
ctccgctttaaccccaacctccagccgc

SEQ ID NO: 3104 - DNA, 20 bp, synthetic construct
  misc_feature 1..20: note = Synthetic
  source 1..20: mol_type = other DNA
gtcatcttagtcattacctg

SEQ ID NO: 3105 - DNA, 20 bp, synthetic construct
  misc_feature 1..20: note = Synthetic
  source 1..20: mol_type = other DNA
gagtccgagcagaagaagaa

SEQ ID NO: 3106 - DNA, 20 bp, synthetic construct
  misc_feature 1..20: note = Synthetic
  source 1..20: mol_type = other DNA
ggaatcccttctgcagcacc

SEQ ID NO: 3107 - DNA, 20 bp, synthetic construct
  misc_feature 1..20: note = Synthetic
  source 1..20: mol_type = other DNA
ggcccagactgagcacgtga

SEQ ID NO: 3108 - DNA, 20 bp, synthetic construct
  misc_feature 1..20: note = Synthetic
  source 1..20: mol_type = other DNA
ggcactgcggctggaggtgg

SEQ ID NO: 3109 - DNA, 20 bp, synthetic construct
  misc_feature 1..20: note = Synthetic
  source 1..20: mol_type = other DNA
gtcatcttagtcattacctg

SEQ ID NO: 3110 - DNA, 20 bp, synthetic construct
  misc_feature 1..20: note = Synthetic
  source 1..20: mol_type = other DNA
gtcatcttagtcattacctg

SEQ ID NO: 3111 - DNA, 20 bp, synthetic construct
  misc_feature 1..20: note = Synthetic
  source 1..20: mol_type = other DNA
ggaatcccttctgcagcacc

SEQ ID NO: 3112 - DNA, 20 bp, synthetic construct
  misc_feature 1..20: note = Synthetic
  source 1..20: mol_type = other DNA
ggaatcccttctgcagcacc

SEQ ID NO: 3113 - DNA, 29 bp, synthetic construct
  misc_feature 1..29: note = Synthetic
  source 1..29: mol_type = other DNA
aacgaacacctcatgtaatgactaagatg

SEQ ID NO: 3114 - DNA, 28 bp, synthetic construct
  misc_feature 1..28: note = Synthetic
  source 1..28: mol_type = other DNA
atgggagcacttcttcttctgctcggac

SEQ ID NO: 3115 - DNA, 32 bp, synthetic construct; identical to SEQ ID NO: 3023
  misc_feature 1..32: note = Synthetic
  source 1..32: mol_type = other DNA

SEQ ID NO: 3116 - DNA, 23 bp, synthetic construct
  misc_feature 1..23: note = Synthetic
  source 1..23: mol_type = other DNA
tctgccatgacgtgctcagtctg

SEQ ID NO: 3117 - DNA, 19 bp, synthetic construct
  misc_feature 1..19: note = Synthetic
  source 1..19: mol_type = other DNA
ttaaccccaacctccagcc

SEQ ID NO: 3118 - DNA, 29 bp, synthetic construct
  misc_feature 1..29: note = Synthetic
  source 1..29: mol_type = other DNA
aacgaacaccgcaggtaatgactaagatg

SEQ ID NO: 3119 - DNA, 29 bp, synthetic construct
  misc_feature 1..29: note = Synthetic
  source 1..29: mol_type = other DNA
aacgaacaccccaggtaatgactaagatg

SEQ ID NO: 3120 - DNA, 30 bp, synthetic construct; identical to SEQ ID NO: 3021
  misc_feature 1..30: note = Synthetic
  source 1..30: mol_type = other DNA

SEQ ID NO: 3121 - DNA, 31 bp, synthetic construct
  misc_feature 1..31: note = Synthetic
  source 1..31: mol_type = other DNA
ggaaaagcgagccaggtgctgcagaagggat

SEQ ID NO: 3122 - DNA, 21 bp, synthetic construct
  misc_feature 1..21: note = Synthetic
  source 1..21: mol_type = other DNA
gtcaaccattaagcaaaacat

SEQ ID NO: 3123 - DNA, 21 bp, synthetic construct
  misc_feature 1..21: note = Synthetic
  source 1..21: mol_type = other DNA
gtctcaggctgtgcagacaaa

SEQ ID NO: 3124 - DNA, 20 bp, synthetic construct
  misc_feature 1..20: note = Synthetic
  source 1..20: mol_type = other DNA
ggggcacagatgagaaactc

SEQ ID NO: 3125 - DNA, 20 bp, synthetic construct
  misc_feature 1..20: note = Synthetic
  source 1..20: mol_type = other DNA
gccgtttgtactttgtcctc

SEQ ID NO: 3126 - DNA, 20 bp, synthetic construct
  misc_feature 1..20: note = Synthetic
  source 1..20: mol_type = other DNA
gcgccaccggttgatgtgat

SEQ ID NO: 3127 - DNA, 20 bp, synthetic construct
  misc_feature 1..20: note = Synthetic
  source 1..20: mol_type = other DNA
gcttcgtggcaatgcgccac

SEQ ID NO: 3128 - DNA, 20 bp, synthetic construct
  misc_feature 1..20: note = Synthetic
  source 1..20: mol_type = other DNA
gacatcgatgtcctccccat

SEQ ID NO: 3129 - DNA, 21 bp, synthetic construct
  misc_feature 1..21: note = Synthetic
  source 1..21: mol_type = other DNA
gtggttgcccaccctagtcat

SEQ ID NO: 3130 - DNA, 20 bp, synthetic construct
  misc_feature 1..20: note = Synthetic
  source 1..20: mol_type = other DNA
gcgactctctgcgtactgat

SEQ ID NO: 3131 - DNA, 21 bp, synthetic construct
  misc_feature 1..21: note = Synthetic
  source 1..21: mol_type = other DNA
gccctacttccgctttcacct

SEQ ID NO: 3132 - DNA, 20 bp, synthetic construct
  misc_feature 1..20: note = Synthetic
  source 1..20: mol_type = other DNA
ggattccatgaggtgcgcga

SEQ ID NO: 3133 - DNA, 20 bp, synthetic construct
  misc_feature 1..20: note = Synthetic
  source 1..20: mol_type = other DNA
gctgcagaagggattccatg

SEQ ID NO: 3134 - DNA, 20 bp, synthetic construct
  misc_feature 1..20: note = Synthetic
  source 1..20: mol_type = other DNA
gcttgagaccgccagaagct

SEQ ID NO: 3135 - DNA, 20 bp, synthetic construct
  misc_feature 1..20: note = Synthetic
  source 1..20: mol_type = other DNA
ggggtcccaggtgctgacgt

SEQ ID NO: 3136 - DNA, 20 bp, synthetic construct
  misc_feature 1..20: note = Synthetic
  source 1..20: mol_type = other DNA
gcagaaatagactaattgca

SEQ ID NO: 3137 - DNA, 20 bp, synthetic construct
  misc_feature 1..20: note = Synthetic
  source 1..20: mol_type = other DNA
ggattgacccaggccagggc

SEQ ID NO: 3138 - DNA, 20 bp, synthetic construct
  misc_feature 1..20: note = Synthetic
  source 1..20: mol_type = other DNA
gacgccctctggaggaagca

SEQ ID NO: 3139 - DNA, 19 bp, synthetic construct
  misc_feature 1..19: note = Synthetic
  source 1..19: mol_type = other DNA
gctgtcctgcgacgccctc

SEQ ID NO: 3140 - DNA, 20 bp, synthetic construct
  misc_feature 1..20: note = Synthetic
  source 1..20: mol_type = other DNA
gcacatactagcccctgtct

SEQ ID NO: 3141 - DNA, 20 bp, synthetic construct
  misc_feature 1..20: note = Synthetic
  source 1..20: mol_type = other DNA
gtcaaccagtatcccggtgc

SEQ ID NO: 3142 - DNA, 20 bp, synthetic construct
  misc_feature 1..20: note = Synthetic
  source 1..20: mol_type = other DNA
tcccttccttccacccagcc

SEQ ID NO: 3143 - DNA, 20 bp, synthetic construct
  misc_feature 1..20: note = Synthetic
  source 1..20: mol_type = other DNA
ccctgcctgtcatcctgctt

SEQ ID NO: 3144 - DNA, 20 bp, synthetic construct
  misc_feature 1..20: note = Synthetic
  source 1..20: mol_type = other DNA
gcagtgccaccggggcgccg

SEQ ID NO: 3145 - DNA, 20 bp, synthetic construct
  misc_feature 1..20: note = Synthetic
  source 1..20: mol_type = other DNA
gcgggggctcagagagggca

SEQ ID NO: 3146 - DNA, 21 bp, synthetic construct
  misc_feature 1..21: note = Synthetic
  source 1..21: mol_type = other DNA
gagacacacacacaggcctgg

SEQ ID NO: 3147 - DNA, 21 bp, synthetic construct
  misc_feature 1..21: note = Synthetic
  source 1..21: mol_type = other DNA
gtcaaccattaagcaaaacat

SEQ ID NO: 3148 - DNA, 21 bp, synthetic construct
  misc_feature 1..21: note = Synthetic
  source 1..21: mol_type = other DNA
gtgagttacaacgaacaccgc

SEQ ID NO: 3149 - DNA, 21 bp, synthetic construct
  misc_feature 1..21: note = Synthetic
  source 1..21: mol_type = other DNA
gtgagttacaacgaacacccc

SEQ ID NO: 3150 - DNA, 20 bp, synthetic construct
  misc_feature 1..20: note = Synthetic
  source 1..20: mol_type = other DNA
ggggtcccaggtgctgacgt

SEQ ID NO: 3151 - DNA, 20 bp, synthetic construct
  misc_feature 1..20: note = Synthetic
  source 1..20: mol_type = other DNA
gaagctcggaaaagcgatca

SEQ ID NO: 3152 - DNA, 20 bp, synthetic construct
  misc_feature 1..20: note = Synthetic
  source 1..20: mol_type = other DNA
gaagctcggaaaagcgagcc

SEQ ID NO: 3153 - DNA, 20 bp, synthetic construct
  misc_feature 1..20: note = Synthetic
  source 1..20: mol_type = other DNA
gtcaaccagtatcccggtgc

SEQ ID NO: 3154 - DNA, 20 bp, synthetic construct
  misc_feature 1..20: note = Synthetic
  source 1..20: mol_type = other DNA
ggcccagactgagcacgtga

SEQ ID NO: 3155 - DNA, 20 bp, synthetic construct
  misc_feature 1..20: note = Synthetic
  source 1..20: mol_type = other DNA
ggcccagactgagcacgtga

SEQ ID NO: 3156 - DNA, 20 bp, synthetic construct
  misc_feature 1..20: note = Synthetic
  source 1..20: mol_type = other DNA
ggcccagactgagcacgtga

SEQ ID NO: 3157 - DNA, 20 bp, synthetic construct
  misc_feature 1..20: note = Synthetic
  source 1..20: mol_type = other DNA
ggcccagactgagcacgtga

SEQ ID NO: 3158 - DNA, 20 bp, synthetic construct
  misc_feature 1..20: note = Synthetic
  source 1..20: mol_type = other DNA
ggcccagactgagcacgtga

SEQ ID NO: 3159 - DNA, 20 bp, synthetic construct
  misc_feature 1..20: note = Synthetic
  source 1..20: mol_type = other DNA
ggcccagactgagcacgtga

SEQ ID NO: 3160 - DNA, 20 bp, synthetic construct
  misc_feature 1..20: note = Synthetic
  source 1..20: mol_type = other DNA
ggcccagactgagcacgtga

SEQ ID NO: 3161 - DNA, 20 bp, synthetic construct
  misc_feature 1..20: note = Synthetic
  source 1..20: mol_type = other DNA
ggcccagactgagcacgtga

SEQ ID NO: 3162 - DNA, 20 bp, synthetic construct
  misc_feature 1..20: note = Synthetic
  source 1..20: mol_type = other DNA
ggcccagactgagcacgtga

SEQ ID NO: 3163 - DNA, 20 bp, synthetic construct
  misc_feature 1..20: note = Synthetic
  source 1..20: mol_type = other DNA
ggcccagactgagcacgtga

SEQ ID NO: 3164 - DNA, 20 bp, synthetic construct
  misc_feature 1..20: note = Synthetic
  source 1..20: mol_type = other DNA
ggcccagactgagcacgtga

SEQ ID NO: 3165 - DNA, 20 bp, synthetic construct
  misc_feature 1..20: note = Synthetic
  source 1..20: mol_type = other DNA
ggcccagactgagcacgtga

SEQ ID NO: 3166 - DNA, 20 bp, synthetic construct
  misc_feature 1..20: note = Synthetic
  source 1..20: mol_type = other DNA
ggcccagactgagcacgtga

SEQ ID NO: 3167 - DNA, 20 bp, synthetic construct
  misc_feature 1..20: note = Synthetic
  source 1..20: mol_type = other DNA
ggcccagactgagcacgtga

SEQ ID NO: 3168 - DNA, 20 bp, synthetic construct
  misc_feature 1..20: note = Synthetic
  source 1..20: mol_type = other DNA
ggcccagactgagcacgtga

SEQ ID NO: 3169 - DNA, 20 bp, synthetic construct
  misc_feature 1..20: note = Synthetic
  source 1..20: mol_type = other DNA
ggcccagactgagcacgtga

SEQ ID NO: 3170 - DNA, 20 bp, synthetic construct
  misc_feature 1..20: note = Synthetic
  source 1..20: mol_type = other DNA
ggcccagactgagcacgtga

SEQ ID NO: 3171 - DNA, 20 bp, synthetic construct
  misc_feature 1..20: note = Synthetic
  source 1..20: mol_type = other DNA
ggcccagactgagcacgtga

SEQ ID NO: 3172 - DNA, 20 bp, synthetic construct
  misc_feature 1..20: note = Synthetic
  source 1..20: mol_type = other DNA
ggcccagactgagcacgtga

SEQ ID NO: 3173 - DNA, 20 bp, synthetic construct
  misc_feature 1..20: note = Synthetic
  source 1..20: mol_type = other DNA
ggcccagactgagcacgtga

SEQ ID NO: 3174 - DNA, 20 bp, synthetic construct
  misc_feature 1..20: note = Synthetic
  source 1..20: mol_type = other DNA
ggcccagactgagcacgtga

SEQ ID NO: 3175 - DNA, 20 bp, synthetic construct
  misc_feature 1..20: note = Synthetic
  source 1..20: mol_type = other DNA
ggcccagactgagcacgtga

SEQ ID NO: 3176 - DNA, 20 bp, synthetic construct
  misc_feature 1..20: note = Synthetic
  source 1..20: mol_type = other DNA
ggcccagactgagcacgtga

SEQ ID NO: 3177 - DNA, 20 bp, synthetic construct
  misc_feature 1..20: note = Synthetic
  source 1..20: mol_type = other DNA
ggcccagactgagcacgtga

SEQ ID NO: 3178 - DNA, 20 bp, synthetic construct
  misc_feature 1..20: note = Synthetic
  source 1..20: mol_type = other DNA
ggcccagactgagcacgtga

SEQ ID NO: 3179 - DNA, 20 bp, synthetic construct
  misc_feature 1..20: note = Synthetic
  source 1..20: mol_type = other DNA
ggcccagactgagcacgtga

SEQ ID NO: 3180 - DNA, 20 bp, synthetic construct
  misc_feature 1..20: note = Synthetic
  source 1..20: mol_type = other DNA
ggcccagactgagcacgtga

SEQ ID NO: 3181 - DNA, 20 bp, synthetic construct
  misc_feature 1..20: note = Synthetic
  source 1..20: mol_type = other DNA
ggcccagactgagcacgtga

SEQ ID NO: 3182 - DNA, 20 bp, synthetic construct
  misc_feature 1..20: note = Synthetic
  source 1..20: mol_type = other DNA
ggcccagactgagcacgtga

SEQ ID NO: 3183 - DNA, 20 bp, synthetic construct
  misc_feature 1..20: note = Synthetic
  source 1..20: mol_type = other DNA
ggcccagactgagcacgtga

SEQ ID NO: 3184 - DNA, 20 bp, synthetic construct
  misc_feature 1..20: note = Synthetic
  source 1..20: mol_type = other DNA
ggcccagactgagcacgtga

SEQ ID NO: 3185 - DNA, 20 bp, synthetic construct
  misc_feature 1..20: note = Synthetic
  source 1..20: mol_type = other DNA
ggcccagactgagcacgtga

SEQ ID NO: 3186 - DNA, 20 bp, synthetic construct
  misc_feature 1..20: note = Synthetic
  source 1..20: mol_type = other DNA
ggcccagactgagcacgtga

SEQ ID NO: 3187 - DNA, 20 bp, synthetic construct
  misc_feature 1..20: note = Synthetic
  source 1..20: mol_type = other DNA
ggcccagactgagcacgtga

SEQ ID NO: 3188 - DNA, 20 bp, synthetic construct
  misc_feature 1..20: note = Synthetic
  source 1..20: mol_type = other DNA
gtcatcttagtcattacctg

SEQ ID NO: 3189 - DNA, 20 bp, synthetic construct
  misc_feature 1..20: note = Synthetic
  source 1..20: mol_type = other DNA
gtcatcttagtcattacctg

SEQ ID NO: 3190 - DNA, 20 bp, synthetic construct
  misc_feature 1..20: note = Synthetic
  source 1..20: mol_type = other DNA
gtcatcttagtcattacctg

SEQ ID NO: 3191 - DNA, 20 bp, synthetic construct
  misc_feature 1..20: note = Synthetic
  source 1..20: mol_type = other DNA
gtcatcttagtcattacctg

SEQ ID NO: 3192 - DNA, 20 bp, synthetic construct
  misc_feature 1..20: note = Synthetic
  source 1..20: mol_type = other DNA
gtcatcttagtcattacctg

SEQ ID NO: 3193 - DNA, 20 bp, synthetic construct
  misc_feature 1..20: note = Synthetic
  source 1..20: mol_type = other DNA
gtcatcttagtcattacctg

SEQ ID NO: 3194 - DNA, 20 bp, synthetic construct
  misc_feature 1..20: note = Synthetic
  source 1..20: mol_type = other DNA
gtcatcttagtcattacctg

SEQ ID NO: 3195 - DNA, 20 bp, synthetic construct
  misc_feature 1..20: note = Synthetic
  source 1..20: mol_type = other DNA
gtcatcttagtcattacctg

SEQ ID NO: 3196 - DNA, 20 bp, synthetic construct
  misc_feature 1..20: note = Synthetic
  source 1..20: mol_type = other DNA
gtcatcttagtcattacctg

SEQ ID NO: 3197 - DNA, 20 bp, synthetic construct
  misc_feature 1..20: note = Synthetic
  source 1..20: mol_type = other DNA
gtcatcttagtcattacctg

SEQ ID NO: 3198 - DNA, 20 bp, synthetic construct
  misc_feature 1..20: note = Synthetic
  source 1..20: mol_type = other DNA
gtcatcttagtcattacctg

SEQ ID NO: 3199 - DNA, 20 bp, synthetic construct
  misc_feature 1..20: note = Synthetic
  source 1..20: mol_type = other DNA
gtcatcttagtcattacctg

SEQ ID NO: 3200 - DNA, 20 bp, synthetic construct
  misc_feature 1..20: note = Synthetic
  source 1..20: mol_type = other DNA
ggaatcccttctgcagcacc

SEQ ID NO: 3201 - DNA, 20 bp, synthetic construct
  misc_feature 1..20: note = Synthetic
  source 1..20: mol_type = other DNA
ggaatcccttctgcagcacc

SEQ ID NO: 3202 - DNA, 20 bp, synthetic construct
  misc_feature 1..20: note = Synthetic
  source 1..20: mol_type = other DNA
ggaatcccttctgcagcacc

SEQ ID NO: 3203 - DNA, 20 bp, synthetic construct
  misc_feature 1..20: note = Synthetic
  source 1..20: mol_type = other DNA
ggaatcccttctgcagcacc

SEQ ID NO: 3204 - DNA, 20 bp, synthetic construct
  misc_feature 1..20: note = Synthetic
  source 1..20: mol_type = other DNA
ggaatcccttctgcagcacc

SEQ ID NO: 3205 - DNA, 20 bp, synthetic construct
  misc_feature 1..20: note = Synthetic
  source 1..20: mol_type = other DNA
ggaatcccttctgcagcacc

SEQ ID NO: 3206 - DNA, 20 bp, synthetic construct
  misc_feature 1..20: note = Synthetic
  source 1..20: mol_type = other DNA
ggaatcccttctgcagcacc

SEQ ID NO: 3207 - DNA, 20 bp, synthetic construct
  misc_feature 1..20: note = Synthetic
  source 1..20: mol_type = other DNA
ggaatcccttctgcagcacc

SEQ ID NO: 3208 - DNA, 20 bp, synthetic construct
  misc_feature 1..20: note = Synthetic
  source 1..20: mol_type = other DNA
ggaatcccttctgcagcacc

SEQ ID NO: 3209 - DNA, 20 bp, synthetic construct
  misc_feature 1..20: note = Synthetic
  source 1..20: mol_type = other DNA
ggaatcccttctgcagcacc

SEQ ID NO: 3210 - DNA, 20 bp, synthetic construct
  misc_feature 1..20: note = Synthetic
  source 1..20: mol_type = other DNA
ggaatcccttctgcagcacc

SEQ ID NO: 3211 - DNA, 20 bp, synthetic construct
  misc_feature 1..20: note = Synthetic
  source 1..20: mol_type = other DNA
ggaatcccttctgcagcacc

SEQ ID NO: 3212 - DNA, 20 bp, synthetic construct
  misc_feature 1..20: note = Synthetic
  source 1..20: mol_type = other DNA
gagtccgagcagaagaagaa

SEQ ID NO: 3213 - DNA, 20 bp, synthetic construct
  misc_feature 1..20: note = Synthetic
  source 1..20: mol_type = other DNA
gagtccgagcagaagaagaa

SEQ ID NO: 3214 - DNA, 20 bp, synthetic construct
  misc_feature 1..20: note = Synthetic
  source 1..20: mol_type = other DNA
gagtccgagcagaagaagaa

SEQ ID NO: 3215 - DNA, 20 bp, synthetic construct
  misc_feature 1..20: note = Synthetic
  source 1..20: mol_type = other DNA
gagtccgagcagaagaagaa

SEQ ID NO: 3216 - DNA, 20 bp, synthetic construct
  misc_feature 1..20: note = Synthetic
  source 1..20: mol_type = other DNA
gagtccgagcagaagaagaa

SEQ ID NO: 3217 - DNA, 20 bp, synthetic construct
  misc_feature 1..20: note = Synthetic
  source 1..20: mol_type = other DNA
gagtccgagcagaagaagaa

SEQ ID NO: 3218 - DNA, 20 bp, synthetic construct
  misc_feature 1..20: note = Synthetic
  source 1..20: mol_type = other DNA
gagtccgagcagaagaagaa

SEQ ID NO: 3219 - DNA, 20 bp, synthetic construct
  misc_feature 1..20: note = Synthetic
  source 1..20: mol_type = other DNA
gagtccgagcagaagaagaa

SEQ ID NO: 3220 - DNA, 20 bp, synthetic construct
  misc_feature 1..20: note = Synthetic
  source 1..20: mol_type = other DNA
gagtccgagcagaagaagaa

SEQ ID NO: 3221 - DNA, 20 bp, synthetic construct
  misc_feature 1..20: note = Synthetic
  source 1..20: mol_type = other DNA
gagtccgagcagaagaagaa

SEQ ID NO: 3222 - DNA, 20 bp, synthetic construct
  misc_feature 1..20: note = Synthetic
  source 1..20: mol_type = other DNA
gagtccgagcagaagaagaa

SEQ ID NO: 3223 - DNA, 20 bp, synthetic construct
  misc_feature 1..20: note = Synthetic
  source 1..20: mol_type = other DNA
gagtccgagcagaagaagaa

SEQ ID NO: 3224 - DNA, 20 bp, synthetic construct
  misc_feature 1..20: note = Synthetic
  source 1..20: mol_type = other DNA
gcattttcaggaggaagcga

SEQ ID NO: 3225 - DNA, 20 bp, synthetic construct
  misc_feature 1..20: note = Synthetic
  source 1..20: mol_type = other DNA
gcattttcaggaggaagcga

SEQ ID NO: 3226 - DNA, 20 bp, synthetic construct
  misc_feature 1..20: note = Synthetic
  source 1..20: mol_type = other DNA
gcattttcaggaggaagcga

SEQ ID NO: 3227 - DNA, 20 bp, synthetic construct
  misc_feature 1..20: note = Synthetic
  source 1..20: mol_type = other DNA
gcattttcaggaggaagcga

SEQ ID NO: 3228 - DNA, 20 bp, synthetic construct
  misc_feature 1..20: note = Synthetic
  source 1..20: mol_type = other DNA
gcattttcaggaggaagcga

SEQ ID NO: 3229 - DNA, 20 bp, synthetic construct
  misc_feature 1..20: note = Synthetic
  source 1..20: mol_type = other DNA
gcattttcaggaggaagcga

SEQ ID NO: 3230 - DNA, 20 bp, synthetic construct
  misc_feature 1..20: note = Synthetic
  source 1..20: mol_type = other DNA
gcattttcaggaggaagcga

SEQ ID NO: 3231 - DNA, 20 bp, synthetic construct
  misc_feature 1..20: note = Synthetic
  source 1..20: mol_type = other DNA
gcattttcaggaggaagcga

SEQ ID NO: 3232 - DNA, 20 bp, synthetic construct
  misc_feature 1..20: note = Synthetic
  source 1..20: mol_type = other DNA
gcattttcaggaggaagcga

SEQ ID NO: 3233 - DNA, 20 bp, synthetic construct
  misc_feature 1..20: note = Synthetic
  source 1..20: mol_type = other DNA
gcattttcaggaggaagcga

SEQ ID NO: 3234 - DNA, 20 bp, synthetic construct
  misc_feature 1..20: note = Synthetic
  source 1..20: mol_type = other DNA
gcattttcaggaggaagcga

SEQ ID NO: 3235 - DNA, 20 bp, synthetic construct
  misc_feature 1..20: note = Synthetic
  source 1..20: mol_type = other DNA
gcattttcaggaggaagcga

SEQ ID NO: 3236 - DNA, 20 bp, synthetic construct
  misc_feature 1..20: note = Synthetic
  source 1..20: mol_type = other DNA
gatgtctgcaggccagatga

SEQ ID NO: 3237 - DNA, 20 bp, synthetic construct
  misc_feature 1..20: note = Synthetic
  source 1..20: mol_type = other DNA
gatgtctgcaggccagatga

SEQ ID NO: 3238 - DNA, 20 bp, synthetic construct
  misc_feature 1..20: note = Synthetic
  source 1..20: mol_type = other DNA
gatgtctgcaggccagatga

SEQ ID NO: 3239 - DNA, 20 bp, synthetic construct
  misc_feature 1..20: note = Synthetic
  source 1..20: mol_type = other DNA
gatgtctgcaggccagatga

SEQ ID NO: 3240 - DNA, 20 bp, synthetic construct
  misc_feature 1..20: note = Synthetic
  source 1..20: mol_type = other DNA
gatgtctgcaggccagatga

SEQ ID NO: 3241 - DNA, 20 bp, synthetic construct
  misc_feature 1..20: note = Synthetic
  source 1..20: mol_type = other DNA
gatgtctgcaggccagatga

SEQ ID NO: 3242 - DNA, 20 bp, synthetic construct
  misc_feature 1..20: note = Synthetic
  source 1..20: mol_type = other DNA
gatgtctgcaggccagatga

SEQ ID NO: 3243 - DNA, 20 bp, synthetic construct
  misc_feature 1..20: note = Synthetic
  source 1..20: mol_type = other DNA
gatgtctgcaggccagatga

SEQ ID NO: 3244 - DNA, 20 bp, synthetic construct
  misc_feature 1..20: note = Synthetic
  source 1..20: mol_type = other DNA
gatgtctgcaggccagatga

SEQ ID NO: 3245 - DNA, 20 bp, synthetic construct
  misc_feature 1..20: note = Synthetic
  source 1..20: mol_type = other DNA
gatgtctgcaggccagatga

SEQ ID NO: 3246 - DNA, 20 bp, synthetic construct
  misc_feature 1..20: note = Synthetic
  source 1..20: mol_type = other DNA
gatgtctgcaggccagatga

SEQ ID NO: 3247 - DNA, 20 bp, synthetic construct
  misc_feature 1..20: note = Synthetic
  source 1..20: mol_type = other DNA
gatgtctgcaggccagatga

SEQ ID NO: 3248 - DNA, 20 bp, synthetic construct
  misc_feature 1..20: note = Synthetic
  source 1..20: mol_type = other DNA
gattcctggtgccagaaaca

SEQ ID NO: 3249 - DNA, 20 bp, synthetic construct
  misc_feature 1..20: note = Synthetic
  source 1..20: mol_type = other DNA
gattcctggtgccagaaaca

SEQ ID NO: 3250 - DNA, 20 bp, synthetic construct
  misc_feature 1..20: note = Synthetic
  source 1..20: mol_type = other DNA
gattcctggtgccagaaaca

SEQ ID NO: 3251 - DNA, 20 bp, synthetic construct
  misc_feature 1..20: note = Synthetic
  source 1..20: mol_type = other DNA
gattcctggtgccagaaaca

SEQ ID NO: 3252 - DNA, 20 bp, synthetic construct
  misc_feature 1..20: note = Synthetic
  source 1..20: mol_type = other DNA
gattcctggtgccagaaaca

SEQ ID NO: 3253 - DNA, 20 bp, synthetic construct
  misc_feature 1..20: note = Synthetic
  source 1..20: mol_type = other DNA
gattcctggtgccagaaaca

SEQ ID NO: 3254 - DNA, 20 bp, synthetic construct
  misc_feature 1..20: note = Synthetic
  source 1..20: mol_type = other DNA
gattcctggtgccagaaaca

SEQ ID NO: 3255 - DNA, 20 bp, synthetic construct
  misc_feature 1..20: note = Synthetic
  source 1..20: mol_type = other DNA
gattcctggtgccagaaaca

SEQ ID NO: 3256 - DNA, 20 bp, synthetic construct
  misc_feature 1..20: note = Synthetic
  source 1..20: mol_type = other DNA
gattcctggtgccagaaaca

SEQ ID NO: 3257 - DNA, 20 bp, synthetic construct
  misc_feature 1..20: note = Synthetic
  source 1..20: mol_type = other DNA
gattcctggtgccagaaaca

SEQ ID NO: 3258 - DNA, 20 bp, synthetic construct
  misc_feature 1..20: note = Synthetic
  source 1..20: mol_type = other DNA
gattcctggtgccagaaaca

SEQ ID NO: 3259 - DNA, 20 bp, synthetic construct
  misc_feature 1..20: note = Synthetic
  source 1..20: mol_type = other DNA
gattcctggtgccagaaaca

SEQ ID NO: 3260 - DNA, 20 bp, synthetic construct
  misc_feature 1..20: note = Synthetic
  source 1..20: mol_type = other DNA
ggcccagactgagcacgtga

SEQ ID NO: 3261 - DNA, 20 bp, synthetic construct
  misc_feature 1..20: note = Synthetic
  source 1..20: mol_type = other DNA
ggcccagactgagcacgtga

SEQ ID NO: 3262 - DNA, 20 bp, synthetic construct
  misc_feature 1..20: note = Synthetic
  source 1..20: mol_type = other DNA
ggcccagactgagcacgtga

SEQ ID NO: 3263 - DNA, 20 bp, synthetic construct
  misc_feature 1..20: note = Synthetic
  source 1..20: mol_type = other DNA
ggcccagactgagcacgtga

SEQ ID NO: 3264 - DNA, 20 bp, synthetic construct
  misc_feature 1..20: note = Synthetic
  source 1..20: mol_type = other DNA
ggcccagactgagcacgtga

SEQ ID NO: 3265 - DNA, 20 bp, synthetic construct
  misc_feature 1..20: note = Synthetic
  source 1..20: mol_type = other DNA
ggcccagactgagcacgtga

SEQ ID NO: 3266 - DNA, 20 bp, synthetic construct
  misc_feature 1..20: note = Synthetic
  source 1..20: mol_type = other DNA
ggcccagactgagcacgtga

SEQ ID NO: 3267 - DNA, 20 bp, synthetic construct
  misc_feature 1..20: note = Synthetic
  source 1..20: mol_type = other DNA
ggcccagactgagcacgtga

SEQ ID NO: 3268 - DNA, 20 bp, synthetic construct
  misc_feature 1..20: note = Synthetic
  source 1..20: mol_type = other DNA
ggcccagactgagcacgtga

SEQ ID NO: 3269 - DNA, 20 bp, synthetic construct
  misc_feature 1..20: note = Synthetic
  source 1..20: mol_type = other DNA
ggcccagactgagcacgtga

SEQ ID NO: 3270 - DNA, 20 bp, synthetic construct
  misc_feature 1..20: note = Synthetic
  source 1..20: mol_type = other DNA
gtcatcttagtcattacctg

SEQ ID NO: 3271 - DNA, 20 bp, synthetic construct
  misc_feature 1..20: note = Synthetic
  source 1..20: mol_type = other DNA
gtcatcttagtcattacctg

SEQ ID NO: 3272 - DNA, 20 bp, synthetic construct
  misc_feature 1..20: note = Synthetic
  source 1..20: mol_type = other DNA
gtcatcttagtcattacctg

SEQ ID NO: 3273 - DNA, 20 bp, synthetic construct
  misc_feature 1..20: note = Synthetic
  source 1..20: mol_type = other DNA
gtcatcttagtcattacctg

SEQ ID NO: 3274 - DNA, 20 bp, synthetic construct
  misc_feature 1..20: note = Synthetic
  source 1..20: mol_type = other DNA
ggaatcccttctgcagcacc

SEQ ID NO: 3275 - DNA, 20 bp, synthetic construct
  misc_feature 1..20: note = Synthetic
  source 1..20: mol_type = other DNA
ggaatcccttctgcagcacc

SEQ ID NO: 3276 - DNA, 20 bp, synthetic construct
  misc_feature 1..20: note = Synthetic
  source 1..20: mol_type = other DNA
ggaatcccttctgcagcacc

SEQ ID NO: 3277 - DNA, 20 bp, synthetic construct
  misc_feature 1..20: note = Synthetic
  source 1..20: mol_type = other DNA
ggaatcccttctgcagcacc

SEQ ID NO: 3278 - DNA, 20 bp, synthetic construct
  misc_feature 1..20: note = Synthetic
  source 1..20: mol_type = other DNA
gagtccgagcagaagaagaa

SEQ ID NO: 3279 - DNA, 20 bp, synthetic construct
  misc_feature 1..20: note = Synthetic
  source 1..20: mol_type = other DNA
gagtccgagcagaagaagaa

SEQ ID NO: 3280 - DNA, 20 bp, synthetic construct
  misc_feature 1..20: note = Synthetic
  source 1..20: mol_type = other DNA
gagtccgagcagaagaagaa

SEQ ID NO: 3281 - DNA, 20 bp, synthetic construct
  misc_feature 1..20: note = Synthetic
  source 1..20: mol_type = other DNA
gagtccgagcagaagaagaa

SEQ ID NO: 3282 - DNA, 20 bp, synthetic construct
  misc_feature 1..20: note = Synthetic
  source 1..20: mol_type = other DNA
gcattttcaggaggaagcga

SEQ ID NO: 3283 - DNA, 20 bp, synthetic construct
  misc_feature 1..20: note = Synthetic
  source 1..20: mol_type = other DNA
gcattttcaggaggaagcga

SEQ ID NO: 3284 - DNA, 20 bp, synthetic construct
  misc_feature 1..20: note = Synthetic
  source 1..20: mol_type = other DNA
gcattttcaggaggaagcga

SEQ ID NO: 3285 - DNA, 20 bp, synthetic construct
  misc_feature 1..20: note = Synthetic
  source 1..20: mol_type = other DNA
gcattttcaggaggaagcga

SEQ ID NO: 3286 - DNA, 20 bp, synthetic construct
  misc_feature 1..20: note = Synthetic
  source 1..20: mol_type = other DNA
gatgtctgcaggccagatga

SEQ ID NO: 3287 - DNA, 20 bp, synthetic construct
  misc_feature 1..20: note = Synthetic
  source 1..20: mol_type = other DNA
gatgtctgcaggccagatga

SEQ ID NO: 3288 - DNA, 20 bp, synthetic construct
  misc_feature 1..20: note = Synthetic
  source 1..20: mol_type = other DNA
gatgtctgcaggccagatga

SEQ ID NO: 3289 - DNA, 20 bp, synthetic construct
  misc_feature 1..20: note = Synthetic
  source 1..20: mol_type = other DNA
gatgtctgcaggccagatga

SEQ ID NO: 3290 - DNA, 20 bp, synthetic construct
  misc_feature 1..20: note = Synthetic
  source 1..20: mol_type = other DNA
gattcctggtgccagaaaca

SEQ ID NO: 3291 - DNA, 20 bp, synthetic construct
  misc_feature 1..20: note = Synthetic
  source 1..20: mol_type = other DNA
gattcctggtgccagaaaca

SEQ ID NO: 3292 - DNA, 20 bp, synthetic construct
  misc_feature 1..20: note = Synthetic
  source 1..20: mol_type = other DNA
gattcctggtgccagaaaca

SEQ ID NO: 3293 - DNA, 20 bp, synthetic construct
  misc_feature 1..20: note = Synthetic
  source 1..20: mol_type = other DNA
gattcctggtgccagaaaca

SEQ ID NO: 3294 - DNA, 20 bp, synthetic construct
  misc_feature 1..20: note = Synthetic
  source 1..20: mol_type = other DNA
ggcccagactgagcacgtga

SEQ ID NO: 3295 - DNA, 20 bp, synthetic construct
  misc_feature 1..20: note = Synthetic
  source 1..20: mol_type = other DNA
ggcccagactgagcacgtga

SEQ ID NO: 3296 - DNA, 20 bp, synthetic construct
  misc_feature 1..20: note = Synthetic
  source 1..20: mol_type = other DNA
ggcccagactgagcacgtga

SEQ ID NO: 3297 - DNA, 20 bp, synthetic construct
  misc_feature 1..20: note = Synthetic
  source 1..20: mol_type = other DNA
ggcccagactgagcacgtga

SEQ ID NO: 3298 - DNA, 20 bp, synthetic construct
  misc_feature 1..20: note = Synthetic
  source 1..20: mol_type = other DNA
gtcatcttagtcattacctg

SEQ ID NO: 3299 - DNA, 20 bp, synthetic construct
  misc_feature 1..20: note = Synthetic
  source 1..20: mol_type = other DNA
gtcatcttagtcattacctg

SEQ ID NO: 3300 - DNA, 20 bp, synthetic construct
  misc_feature 1..20: note = Synthetic
  source 1..20: mol_type = other DNA
gtcatcttagtcattacctg

SEQ ID NO: 3301 - DNA, 20 bp, synthetic construct
  misc_feature 1..20: note = Synthetic
  source 1..20: mol_type = other DNA
gtcatcttagtcattacctg

SEQ ID NO: 3302 - DNA, 20 bp, synthetic construct
  misc_feature 1..20: note = Synthetic
  source 1..20: mol_type = other DNA
ggaatcccttctgcagcacc

SEQ ID NO: 3303 - DNA, 20 bp, synthetic construct
  misc_feature 1..20: note = Synthetic
  source 1..20: mol_type = other DNA
ggaatcccttctgcagcacc

SEQ ID NO: 3304 - DNA, 20 bp, synthetic construct
  misc_feature 1..20: note = Synthetic
  source 1..20: mol_type = other DNA
ggaatcccttctgcagcacc

SEQ ID NO: 3305 - DNA, 23 bp, synthetic construct
  misc_feature 1..23: note = Synthetic
  source 1..23: mol_type = other DNA
tctgccatctcgtgctcagtctg

SEQ ID NO: 3306 - DNA, 23 bp, synthetic construct
  misc_feature 1..23: note = Synthetic
  source 1..23: mol_type = other DNA
tctgccatcgcgtgctcagtctg

SEQ ID NO: 3307 - DNA, 23 bp, synthetic construct
  misc_feature 1..23: note = Synthetic
  source 1..23: mol_type = other DNA
tctgccatcccgtgctcagtctg

SEQ ID NO: 3308 - DNA, 23 bp, synthetic construct
  misc_feature 1..23: note = Synthetic
  source 1..23: mol_type = other DNA
tctgccattacgtgctcagtctg

SEQ ID NO: 3309 - DNA, 23 bp, synthetic construct
  misc_feature 1..23: note = Synthetic
  source 1..23: mol_type = other DNA
tctgccatgacgtgctcagtctg

SEQ ID NO: 3310 - DNA, 23 bp, synthetic construct
  misc_feature 1..23: note = Synthetic
  source 1..23: mol_type = other DNA
tctgccataacgtgctcagtctg

SEQ ID NO: 3311 - DNA, 23 bp, synthetic construct
  misc_feature 1..23: note = Synthetic
  source 1..23: mol_type = other DNA
tctgccagcacgtgctcagtctg

SEQ ID NO: 3312 - DNA, 23 bp, synthetic construct
  misc_feature 1..23: note = Synthetic
  source 1..23: mol_type = other DNA
tctgccaccacgtgctcagtctg

SEQ ID NO: 3313 - DNA, 23 bp, synthetic construct
  misc_feature 1..23: note = Synthetic
  source 1..23: mol_type = other DNA
tctgccaacacgtgctcagtctg

SEQ ID NO: 3314 - DNA, 23 bp, synthetic construct
  misc_feature 1..23: note = Synthetic
  source 1..23: mol_type = other DNA
tctgccttcacgtgctcagtctg

SEQ ID NO: 3315 - DNA, 23 bp, synthetic construct
  misc_feature 1..23: note = Synthetic
  source 1..23: mol_type = other DNA
tctgccgtcacgtgctcagtctg

SEQ ID NO: 3316 - DNA, 23 bp, synthetic construct
  misc_feature 1..23: note = Synthetic
  source 1..23: mol_type = other DNA
tctgccctcacgtgctcagtctg

SEQ ID NO: 3317 - DNA, 23 bp, synthetic construct
  misc_feature 1..23: note = Synthetic
  source 1..23: mol_type = other DNA
tctgctatcacgtgctcagtctg

SEQ ID NO: 3318 - DNA, 23 bp, synthetic construct
  misc_feature 1..23: note = Synthetic
  source 1..23: mol_type = other DNA
tctgcgatcacgtgctcagtctg

SEQ ID NO: 3319 - DNA, 23 bp, synthetic construct
  misc_feature 1..23: note = Synthetic
  source 1..23: mol_type = other DNA
tctgcaatcacgtgctcagtctg

SEQ ID NO: 3320 - DNA, 23 bp, synthetic construct
  misc_feature 1..23: note = Synthetic
  source 1..23: mol_type = other DNA
tctgtcatcacgtgctcagtctg

SEQ ID NO: 3321 - DNA, 23 bp, synthetic construct
  misc_feature 1..23: note = Synthetic
  source 1..23: mol_type = other DNA
tctggcatcacgtgctcagtctg

SEQ ID NO: 3322 - DNA, 23 bp, synthetic construct
  misc_feature 1..23: note = Synthetic
  source 1..23: mol_type = other DNA
tctgacatcacgtgctcagtctg

SEQ ID NO: 3323 - DNA, 23 bp, synthetic construct
  misc_feature 1..23: note = Synthetic
  source 1..23: mol_type = other DNA
tcttccatcacgtgctcagtctg

SEQ ID NO: 3324 - DNA, 23 bp, synthetic construct
  misc_feature 1..23: note = Synthetic
  source 1..23: mol_type = other DNA
tctcccatcacgtgctcagtctg

SEQ ID NO: 3325 - DNA, 23 bp, synthetic construct
  misc_feature 1..23: note = Synthetic
  source 1..23: mol_type = other DNA
tctaccatcacgtgctcagtctg

SEQ ID NO: 3326 - DNA, 23 bp, synthetic construct
  misc_feature 1..23: note = Synthetic
  source 1..23: mol_type = other DNA
tcggccatcacgtgctcagtctg

SEQ ID NO: 3327 - DNA, 23 bp, synthetic construct
  misc_feature 1..23: note = Synthetic
  source 1..23: mol_type = other DNA
tccgccatcacgtgctcagtctg

SEQ ID NO: 3328 - DNA, 23 bp, synthetic construct
  misc_feature 1..23: note = Synthetic
  source 1..23: mol_type = other DNA
tcagccatcacgtgctcagtctg

SEQ ID NO: 3329 - DNA, 47 bp, synthetic construct
  misc_feature 1..47: note = Synthetic
  source 1..47: mol_type = other DNA
tggaggaagcagggcttcctttcctctgccatctcgtgctcagtctg

SEQ ID NO: 3330 - DNA, 47 bp, synthetic construct
  misc_feature 1..47: note = Synthetic
  source 1..47: mol_type = other DNA
tggaggaagcagggcttcctttgctctgccatcacgtgctcagtctg

SEQ ID NO: 3331 - DNA, 47 bp, synthetic construct
  misc_feature 1..47: note = Synthetic
  source 1..47: mol_type = other DNA
tggaggaagcagggcttcctatcctctgccatcacgtgctcagtctg

SEQ ID NO: 3332 - DNA, 47 bp, synthetic construct
  misc_feature 1..47: note = Synthetic
  source 1..47: mol_type = other DNA
tggaggaagcagggcttgctttcctctgccatcacgtgctcagtctg

SEQ ID NO: 3333 - DNA, 47 bp, synthetic construct
  misc_feature 1..47: note = Synthetic
  source 1..47: mol_type = other DNA
tggaggaagcaggggttcctttcctctgccatcacgtgctcagtctg

SEQ ID NO: 3334 - DNA, 47 bp, synthetic construct
  misc_feature 1..47: note = Synthetic
  source 1..47: mol_type = other DNA
tggaggaagcacggcttcctttcctctgccatcacgtgctcagtctg

SEQ ID NO: 3335 - DNA, 47 bp, synthetic construct
  misc_feature 1..47: note = Synthetic
  source 1..47: mol_type = other DNA
tggaggaagctgggcttcctttcctctgccatcacgtgctcagtctg

SEQ ID NO: 3336 - DNA, 47 bp, synthetic construct
  misc_feature 1..47: note = Synthetic
  source 1..47: mol_type = other DNA
tggaggaaccagggcttcctttcctctgccatcacgtgctcagtctg

SEQ ID NO: 3337 - DNA, 47 bp, synthetic construct
  misc_feature 1..47: note = Synthetic
  source 1..47: mol_type = other DNA
tggacgaagcagggcttcctttcctctgccatcacgtgctcagtctg

SEQ ID NO: 3338 - DNA, 47 bp, synthetic construct
  misc_feature 1..47: note = Synthetic
  source 1..47: mol_type = other DNA
tcgaggaagcagggcttcctttcctctgccatcacgtgctcagtctg

SEQ ID NO: 3339 - DNA, 29 bp, synthetic construct
  misc_feature 1..29: note = Synthetic
  source 1..29: mol_type = other DNA
aacgaacacctcatgtaatgactaagatg

SEQ ID NO: 3340 - DNA, 29 bp, synthetic construct
  misc_feature 1..29: note = Synthetic
  source 1..29: mol_type = other DNA
aacgaacacctcacgtaatgactaagatg

SEQ ID NO: 3341 - DNA, 29 bp, synthetic construct
  misc_feature 1..29: note = Synthetic
  source 1..29: mol_type = other DNA
aacgaacacctcaagtaatgactaagatg

SEQ ID NO: 3342 - DNA, 29 bp, synthetic construct
  misc_feature 1..29: note = Synthetic
  source 1..29: mol_type = other DNA
aacgaacacctctggtaatgactaagatg

SEQ ID NO: 3343 - DNA, 29 bp, synthetic construct
  misc_feature 1..29: note = Synthetic
  source 1..29: mol_type = other DNA
aacgaacacctccggtaatgactaagatg

SEQ ID NO: 3344 - DNA, 29 bp, synthetic construct
  misc_feature 1..29: note = Synthetic
  source 1..29: mol_type = other DNA
aacgaacacctgaggtaatgactaagatg

SEQ ID NO: 3345 - DNA, 29 bp, synthetic construct
  misc_feature 1..29: note = Synthetic
  source 1..29: mol_type = other DNA
aacgaacaccgcaggtaatgactaagatg

SEQ ID NO: 3346 - DNA, 29 bp, synthetic construct
  misc_feature 1..29: note = Synthetic
  source 1..29: mol_type = other DNA
aacgaacaccacaggtaatgactaagatg

SEQ ID NO: 3347 - DNA, 29 bp, synthetic construct
  misc_feature 1..29: note = Synthetic
  source 1..29: mol_type = other DNA
aacgaacaccccaggtaatgactaagatg

SEQ ID NO: 3348 - DNA, 29 bp, synthetic construct
  misc_feature 1..29: note = Synthetic
  source 1..29: mol_type = other DNA
aacgaacacatcaggtaatgactaagatg

SEQ ID NO: 3349 - DNA, 29 bp, synthetic construct
  misc_feature 1..29: note = Synthetic
  source 1..29: mol_type = other DNA
aacgaacatctcaggtaatgactaagatg

SEQ ID NO: 3350 - DNA, 29 bp, synthetic construct
  misc_feature 1..29: note = Synthetic
  source 1..29: mol_type = other DNA
aacgaacgcctcaggtaatgactaagatg

SEQ ID NO: 3351 - DNA, 31 bp, synthetic construct; identical to SEQ ID NO: 691
  misc_feature 1..31: note = Synthetic
  source 1..31: mol_type = other DNA

SEQ ID NO: 3352 - DNA, 31 bp, synthetic construct
  misc_feature 1..31: note = Synthetic
  source 1..31: mol_type = other DNA
ggaaaagcgatccaggagctgcagaagggat

SEQ ID NO: 3353 - DNA, 31 bp, synthetic construct
  misc_feature 1..31: note = Synthetic
  source 1..31: mol_type = other DNA
ggaaaagcgatccagttgctgcagaagggat

SEQ ID NO: 3354 - DNA, 31 bp, synthetic construct
  misc_feature 1..31: note = Synthetic
  source 1..31: mol_type = other DNA
ggaaaagcgatccacgtgctgcagaagggat

SEQ ID NO: 3355 - DNA, 31 bp, synthetic construct
  misc_feature 1..31: note = Synthetic
  source 1..31: mol_type = other DNA
ggaaaagcgatccaagtgctgcagaagggat

SEQ ID NO: 3356 - DNA, 31 bp, synthetic construct
  misc_feature 1..31: note = Synthetic
  source 1..31: mol_type = other DNA
ggaaaagcgatcctggtgctgcagaagggat

SEQ ID NO: 3357 - DNA, 31 bp, synthetic construct
  misc_feature 1..31: note = Synthetic
  source 1..31: mol_type = other DNA
ggaaaagcgatcccggtgctgcagaagggat

SEQ ID NO: 3358 - DNA, 31 bp, synthetic construct
  misc_feature 1..31: note = Synthetic
  source 1..31: mol_type = other DNA
ggaaaagcgatctaggtgctgcagaagggat

SEQ ID NO: 3359 - DNA, 31 bp, synthetic construct; identical to SEQ ID NO: 690
  misc_feature 1..31: note = Synthetic
  source 1..31: mol_type = other DNA

SEQ ID NO: 3360 - DNA, 31 bp, synthetic construct; identical to SEQ ID NO: 3121
  misc_feature 1..31: note = Synthetic
  source 1..31: mol_type = other DNA

SEQ ID NO: 3361 - DNA, 31 bp, synthetic construct
  misc_feature 1..31: note = Synthetic
  source 1..31: mol_type = other DNA
ggaaaagcggtccaggtgctgcagaagggat

SEQ ID NO: 3362 - DNA, 31 bp, synthetic construct
  misc_feature 1..31: note = Synthetic
  source 1..31: mol_type = other DNA
ggaaaagagatccaggtgctgcagaagggat

SEQ ID NO: 3363 - DNA, 30 bp, synthetic construct; identical to SEQ ID NO: 687
  misc_feature 1..30: note = Synthetic
  source 1..30: mol_type = other DNA

SEQ ID NO: 3364 - DNA, 30 bp, synthetic construct
  misc_feature 1..30: note = Synthetic
  source 1..30: mol_type = other DNA
gtgatgggagccctacttcttctgctcgga

SEQ ID NO: 3365 - DNA, 30 bp, synthetic construct
  misc_feature 1..30: note = Synthetic
  source 1..30: mol_type = other DNA
gtgatgggagcccctcttcttctgctcgga

SEQ ID NO: 3366 - DNA, 30 bp, synthetic construct
  misc_feature 1..30: note = Synthetic
  source 1..30: mol_type = other DNA
gtgatgggagccgttcttcttctgctcgga

SEQ ID NO: 3367 - DNA, 30 bp, synthetic construct
  misc_feature 1..30: note = Synthetic
  source 1..30: mol_type = other DNA
gtgatgggagctcttcttcttctgctcgga

SEQ ID NO: 3368 - DNA, 30 bp, synthetic construct; identical to SEQ ID NO: 686
  misc_feature 1..30: note = Synthetic
  source 1..30: mol_type = other DNA

SEQ ID NO: 3369 - DNA, 30 bp, synthetic construct
  misc_feature 1..30: note = Synthetic
  source 1..30: mol_type = other DNA
gtgatgggatcccttcttcttctgctcgga

SEQ ID NO: 3370 - DNA, 30 bp, synthetic construct
  misc_feature 1..30: note = Synthetic
  source 1..30: mol_type = other DNA
gtgatgggtgcccttcttcttctgctcgga

SEQ ID NO: 3371 - DNA, 30 bp, synthetic construct
  misc_feature 1..30: note = Synthetic
  source 1..30: mol_type = other DNA
gtgatgggggcccttcttcttctgctcgga

SEQ ID NO: 3372 - DNA, 30 bp, synthetic construct
  misc_feature 1..30: note = Synthetic
  source 1..30: mol_type = other DNA
gtgatgggcgcccttcttcttctgctcgga

SEQ ID NO: 3373 - DNA, 30 bp, synthetic construct
  misc_feature 1..30: note = Synthetic
  source 1..30: mol_type = other DNA
gtgatggcagcccttcttcttctgctcgga

SEQ ID NO: 3374 - DNA, 30 bp, synthetic construct
  misc_feature 1..30: note = Synthetic
  source 1..30: mol_type = other DNA
gtgatggaagcccttcttcttctgctcgga

SEQ ID NO: 3375 - DNA, 30 bp, synthetic construct
  misc_feature 1..30: note = Synthetic
  source 1..30: mol_type = other DNA
tgtctgaagccatctcttcctcctgaaaat

SEQ ID NO: 3376 - DNA, 30 bp, synthetic construct
  misc_feature 1..30: note = Synthetic
  source 1..30: mol_type = other DNA
tgtctgaagccatcccttcctcctgaaaat

SEQ ID NO: 3377 - DNA, 30 bp, synthetic construct
  misc_feature 1..30: note = Synthetic
  source 1..30: mol_type = other DNA
tgtctgaagccatcacttcctcctgaaaat

SEQ ID NO: 3378 - DNA, 30 bp, synthetic construct
  misc_feature 1..30: note = Synthetic
  source 1..30: mol_type = other DNA
tgtctgaagccattgcttcctcctgaaaat

SEQ ID NO: 3379 - DNA, 30 bp, synthetic construct
  misc_feature 1..30: note = Synthetic
  source 1..30: mol_type = other DNA
tgtctgaagccagcgcttcctcctgaaaat

SEQ ID NO: 3380 - DNA, 30 bp, synthetic construct
  misc_feature 1..30: note = Synthetic
  source 1..30: mol_type = other DNA
tgtctgaagccaccgcttcctcctgaaaat

SEQ ID NO: 3381 - DNA, 30 bp, synthetic construct
  misc_feature 1..30: note = Synthetic
  source 1..30: mol_type = other DNA
tgtctgaagccaacgcttcctcctgaaaat

SEQ ID NO: 3382 - DNA, 30 bp, synthetic construct
  misc_feature 1..30: note = Synthetic
  source 1..30: mol_type = other DNA
tgtctgaagccttcgcttcctcctgaaaat

SEQ ID NO: 3383 - DNA, 30 bp, synthetic construct
  misc_feature 1..30: note = Synthetic
  source 1..30: mol_type = other DNA
tgtctgaagccgtcgcttcctcctgaaaat

SEQ ID NO: 3384 - DNA, 30 bp, synthetic construct
  misc_feature 1..30: note = Synthetic
  source 1..30: mol_type = other DNA
tgtctgaagccctcgcttcctcctgaaaat

SEQ ID NO: 3385 - DNA, 30 bp, synthetic construct
  misc_feature 1..30: note = Synthetic
  source 1..30: mol_type = other DNA
tgtctgaagcaatcgcttcctcctgaaaat

SEQ ID NO: 3386 - DNA, 30 bp, synthetic construct
  misc_feature 1..30: note = Synthetic
  source 1..30: mol_type = other DNA
tgtctgaaggcatcgcttcctcctgaaaat

SEQ ID NO: 3387 - DNA, 35 bp, synthetic construct
  misc_feature 1..35: note = Synthetic
  source 1..35: mol_type = other DNA
aatgtgccatctggagccctcttctggcctgcaga

SEQ ID NO: 3388 - DNA, 35 bp, synthetic construct
  misc_feature 1..35: note = Synthetic
  source 1..35: mol_type = other DNA
aatgtgccatctggagccctcgtctggcctgcaga

SEQ ID NO: 3389 - DNA, 35 bp, synthetic construct
  misc_feature 1..35: note = Synthetic
  source 1..35: mol_type = other DNA
aatgtgccatctggagccctcctctggcctgcaga

SEQ ID NO: 3390 - DNA, 35 bp, synthetic construct
  misc_feature 1..35: note = Synthetic
  source 1..35: mol_type = other DNA
aatgtgccatctggagcccttatctggcctgcaga

SEQ ID NO: 3391 - DNA, 35 bp, synthetic construct
  misc_feature 1..35: note = Synthetic
  source 1..35: mol_type = other DNA
aatgtgccatctggagcccgcatctggcctgcaga

SEQ ID NO: 3392 - DNA, 35 bp, synthetic construct
  misc_feature 1..35: note = Synthetic
  source 1..35: mol_type = other DNA
aatgtgccatctggagcccccatctggcctgcaga

SEQ ID NO: 3393 - DNA, 35 bp, synthetic construct
  misc_feature 1..35: note = Synthetic
  source 1..35: mol_type = other DNA
aatgtgccatctggagcccacatctggcctgcaga

SEQ ID NO: 3394 - DNA, 35 bp, synthetic construct
  misc_feature 1..35: note = Synthetic
  source 1..35: mol_type = other DNA
aatgtgccatctggagcactcatctggcctgcaga

SEQ ID NO: 3395 - DNA, 35 bp, synthetic construct
  misc_feature 1..35: note = Synthetic
  source 1..35: mol_type = other DNA
aatgtgccatctggaggcctcatctggcctgcaga

SEQ ID NO: 3396 - DNA, 35 bp, synthetic construct
  misc_feature 1..35: note = Synthetic
  source 1..35: mol_type = other DNA
aatgtgccatctggatccctcatctggcctgcaga

SEQ ID NO: 3397 - DNA, 35 bp, synthetic construct
  misc_feature 1..35: note = Synthetic
  source 1..35: mol_type = other DNA
aatgtgccatctggaaccctcatctggcctgcaga

SEQ ID NO: 3398 - DNA, 35 bp, synthetic construct
  misc_feature 1..35: note = Synthetic
  source 1..35: mol_type = other DNA
aatgtgccatctgcagccctcatctggcctgcaga

SEQ ID NO: 3399 - DNA, 24 bp, synthetic construct
  misc_feature 1..24: note = Synthetic
  source 1..24: mol_type = other DNA
gtcacccctggttctggcaccagg

SEQ ID NO: 3400 - DNA, 24 bp, synthetic construct
  misc_feature 1..24: note = Synthetic
  source 1..24: mol_type = other DNA
gtcacccctgcttctggcaccagg

SEQ ID NO: 3401 - DNA, 24 bp, synthetic construct
  misc_feature 1..24: note = Synthetic
  source 1..24: mol_type = other DNA
gtcacccctttttctggcaccagg

SEQ ID NO: 3402 - DNA, 24 bp, synthetic construct
  misc_feature 1..24: note = Synthetic
  source 1..24: mol_type = other DNA
gtcacccctctttctggcaccagg

SEQ ID NO: 3403 - DNA, 24 bp, synthetic construct
  misc_feature 1..24: note = Synthetic
  source 1..24: mol_type = other DNA
gtcacccctatttctggcaccagg

SEQ ID NO: 3404 - DNA, 24 bp, synthetic construct
  misc_feature 1..24: note = Synthetic
  source 1..24: mol_type = other DNA
gtcaccccagtttctggcaccagg

SEQ ID NO: 3405 - DNA, 24 bp, synthetic construct
  misc_feature 1..24: note = Synthetic
  source 1..24: mol_type = other DNA
gtcacccttgtttctggcaccagg

SEQ ID NO: 3406 - DNA, 24 bp, synthetic construct
  misc_feature 1..24: note = Synthetic
  source 1..24: mol_type = other DNA
gtcaccactgtttctggcaccagg

SEQ ID NO: 3407 - DNA, 24 bp, synthetic construct
  misc_feature 1..24: note = Synthetic
  source 1..24: mol_type = other DNA
gtcacgcctgtttctggcaccagg

SEQ ID NO: 3408 - DNA, 32 bp, synthetic construct
  misc_feature 1..32: note = Synthetic
  source 1..32: mol_type = other DNA
gccctcccgtctcccctgtttctggcaccagg

SEQ ID NO: 3409 - DNA, 32 bp, synthetic construct
  misc_feature 1..32: note = Synthetic
  source 1..32: mol_type = other DNA
gccctcccgtcgcccctgtttctggcaccagg

SEQ ID NO: 3410 - DNA, 32 bp, synthetic construct
  misc_feature 1..32: note = Synthetic
  source 1..32: mol_type = other DNA
gccctcccgtcccccctgtttctggcaccagg

SEQ ID NO: 3411 - DNA, 42 bp, synthetic construct
  misc_feature 1..42: note = Synthetic
  source 1..42: mol_type = other DNA
tggaggaagcagggcttcctttcctctgccgtgctcagtctg

SEQ ID NO: 3412 - DNA, 37 bp, synthetic construct
  misc_feature 1..37: note = Synthetic
  source 1..37: mol_type = other DNA
tggaggaagcagggcttcctttcccgtgctcagtctg

SEQ ID NO: 3413 - DNA, 32 bp, synthetic construct
  misc_feature 1..32: note = Synthetic
  source 1..32: mol_type = other DNA
tggaggaagcagggcttcccgtgctcagtctg

SEQ ID NO: 3414 - DNA, 39 bp, synthetic construct
  misc_feature 1..39: note = Synthetic
  source 1..39: mol_type = other DNA
tgtcctgcgacgccctctggaggaagcgtgctcagtctg

SEQ ID NO: 3415 - DNA, 34 bp, synthetic construct
  misc_feature 1..34: note = Synthetic
  source 1..34: mol_type = other DNA
tgtcctgcgacgccctctggacgtgctcagtctg

SEQ ID NO: 3416 - DNA, 33 bp, synthetic construct
  misc_feature 1..33: note = Synthetic
  source 1..33: mol_type = other DNA
agtatcccggtgcaggagctcgtgctcagtctg

SEQ ID NO: 3417 - DNA, 24 bp, synthetic construct
  misc_feature 1..24: note = Synthetic
  source 1..24: mol_type = other DNA
tctgccatcatcgtgctcagtctg

SEQ ID NO: 3418 - DNA, 26 bp, synthetic construct
  misc_feature 1..26: note = Synthetic
  source 1..26: mol_type = other DNA
tctgccatcaaagcgtgctcagtctg

SEQ ID NO: 3419 - DNA, 22 bp, synthetic construct
  misc_feature 1..22: note = Synthetic
  source 1..22: mol_type = other DNA
tctgccatccgtgctcagtctg

SEQ ID NO: 3420 - DNA, 44 bp, synthetic construct
  misc_feature 1..44: note = Synthetic
  source 1..44: mol_type = other DNA
tggaggaagcagggcttcctttcctctgccacgtgctcagtctg

SEQ ID NO: 3421 - DNA, 30 bp, synthetic construct
  misc_feature 1..30: note = Synthetic
  source 1..30: mol_type = other DNA
aacgaacacctcagagtaatgactaagatg

SEQ ID NO: 3422 - DNA, 32 bp, synthetic construct; identical to SEQ ID NO: 648
  misc_feature 1..32: note = Synthetic
  source 1..32: mol_type = other DNA

SEQ ID NO: 3423 - DNA, 28 bp, synthetic construct
  misc_feature 1..28: note = Synthetic
  source 1..28: mol_type = other DNA
aacgaacacccaggtaatgactaagatg

SEQ ID NO: 3424 - DNA, 26 bp, synthetic construct
  misc_feature 1..26: note = Synthetic
  source 1..26: mol_type = other DNA
aacgaacacaggtaatgactaagatg

SEQ ID NO: 3425 - DNA, 32 bp, synthetic construct
  misc_feature 1..32: note = Synthetic
  source 1..32: mol_type = other DNA
ggaaaagcgatccagggtgctgcagaagggat

SEQ ID NO: 3426 - DNA, 34 bp, synthetic construct; identical to SEQ ID NO: 692
  misc_feature 1..34: note = Synthetic
  source 1..34: mol_type = other DNA

SEQ ID NO: 3427 - DNA, 30 bp, synthetic construct
  misc_feature 1..30: note = Synthetic
  source 1..30: mol_type = other DNA
ggaaaagcgatcaggtgctgcagaagggat

SEQ ID NO: 3428 - DNA, 28 bp, synthetic construct
  misc_feature 1..28: note = Synthetic
  source 1..28: mol_type = other DNA
ggaaaagcgaaggtgctgcagaagggat

SEQ ID NO: 3429 - DNA, 31 bp, synthetic construct
  misc_feature 1..31: note = Synthetic
  source 1..31: mol_type = other DNA
gtgatgggagcaccttcttcttctgctcgga

SEQ ID NO: 3430 - DNA, 33 bp, synthetic construct; identical to SEQ ID NO: 688
  misc_feature 1..33: note = Synthetic
  source 1..33: mol_type = other DNA

SEQ ID NO: 3431 - DNA, 29 bp, synthetic construct
  misc_feature 1..29: note = Synthetic
  source 1..29: mol_type = other DNA
gtgatgggagccttcttcttctgctcgga

SEQ ID NO: 3432 - DNA, 27 bp, synthetic construct
  misc_feature 1..27: note = Synthetic
  source 1..27: mol_type = other DNA
gtgatgggagttcttcttctgctcgga

SEQ ID NO: 3433 - DNA, 31 bp, synthetic construct
  misc_feature 1..31: note = Synthetic
  source 1..31: mol_type = other DNA
tgtctgaagccatcggcttcctcctgaaaat

SEQ ID NO: 3434 - DNA, 33 bp, synthetic construct
  misc_feature 1..33: note = Synthetic
  source 1..33: mol_type = other DNA
tgtctgaagccatccatgcttcctcctgaaaat

SEQ ID NO: 3435 - DNA, 29 bp, synthetic construct
  misc_feature 1..29: note = Synthetic
  source 1..29: mol_type = other DNA
tgtctgaagccatgcttcctcctgaaaat

SEQ ID NO: 3436 - DNA, 27 bp, synthetic construct
  misc_feature 1..27: note = Synthetic
  source 1..27: mol_type = other DNA
tgtctgaagccgcttcctcctgaaaat

SEQ ID NO: 3437 - DNA, 36 bp, synthetic construct
  misc_feature 1..36: note = Synthetic
  source 1..36: mol_type = other DNA
aatgtgccatctggagccgctcatctggcctgcaga

SEQ ID NO: 3438 - DNA, 38 bp, synthetic construct
  misc_feature 1..38: note = Synthetic
  source 1..38: mol_type = other DNA
aatgtgccatctggagcccttgtcatctggcctgcaga

SEQ ID NO: 3439 - DNA, 34 bp, synthetic construct
  misc_feature 1..34: note = Synthetic
  source 1..34: mol_type = other DNA
aatgtgccatctggagccccatctggcctgcaga

SEQ ID NO: 3440 - DNA, 32 bp, synthetic construct
  misc_feature 1..32: note = Synthetic
  source 1..32: mol_type = other DNA
aatgtgccatctggagccatctggcctgcaga

SEQ ID NO: 3441 - DNA, 29 bp, synthetic construct
  misc_feature 1..29: note = Synthetic
  source 1..29: mol_type = other DNA
tcccgtcacccgctgtttctggcaccagg

SEQ ID NO: 3442 - DNA, 31 bp, synthetic construct
  misc_feature 1..31: note = Synthetic
  source 1..31: mol_type = other DNA
tcccgtcacccctgtgatttctggcaccagg

SEQ ID NO: 3443 - DNA, 27 bp, synthetic construct
  misc_feature 1..27: note = Synthetic
  source 1..27: mol_type = other DNA
tcccgtcaccccgtttctggcaccagg

SEQ ID NO: 3444 - DNA, 25 bp, synthetic construct
  misc_feature 1..25: note = Synthetic
  source 1..25: mol_type = other DNA
tcccgtcaccgtttctggcaccagg

SEQ ID NO: 3445 - DNA, 49 bp, synthetic construct
  misc_feature 1..49: note = Synthetic
  source 1..49: mol_type = other DNA
tggaggaagcagggcttcctttcctctgcatcaaagcgtgctcagtctg

SEQ ID NO: 3446 - DNA, 50 bp, synthetic construct
  misc_feature 1..50: note = Synthetic
  source 1..50: mol_type = other DNA
tggaggaagcagggcttcctttcctctgccatgaaagcgtgctcagtctg

SEQ ID NO: 3447 - DNA, 46 bp, synthetic construct
  misc_feature 1..46: note = Synthetic
  source 1..46: mol_type = other DNA
tggaggaagcagggcttcctttcctctgcgatccgtgctcagtctg

SEQ ID NO: 3448 - DNA, 47 bp, synthetic construct
  misc_feature 1..47: note = Synthetic
  source 1..47: mol_type = other DNA
tggaggaagcagggcttcctttcctctgacatgacgtgctcagtctg

SEQ ID NO: 3449 - DNA, 29 bp, synthetic construct
  misc_feature 1..29: note = Synthetic
  source 1..29: mol_type = other DNA
aacgaacaccattggtaatgactaagatg

SEQ ID NO: 3450 - DNA, 30 bp, synthetic construct
  misc_feature 1..30: note = Synthetic
  source 1..30: mol_type = other DNA
aacgaacacgtcagtgtaatgactaagatg

SEQ ID NO: 3451 - DNA, 27 bp, synthetic construct
  misc_feature 1..27: note = Synthetic
  source 1..27: mol_type = other DNA
aacgaacaactcgtaatgactaagatg

SEQ ID NO: 3452 - DNA, 29 bp, synthetic construct
  misc_feature 1..29: note = Synthetic
  source 1..29: mol_type = other DNA
aacgaacacatcatgtaatgactaagatg

SEQ ID NO: 3453 - DNA, 30 bp, synthetic construct
  misc_feature 1..30: note = Synthetic
  source 1..30: mol_type = other DNA
ggaaaagcgatcggtagctgcagaagggat

SEQ ID NO: 3454 - DNA, 32 bp, synthetic construct
  misc_feature 1..32: note = Synthetic
  source 1..32: mol_type = other DNA
ggaaaagcgattcaggtagctgcagaagggat

SEQ ID NO: 3455 - DNA, 30 bp, synthetic construct
  misc_feature 1..30: note = Synthetic
  source 1..30: mol_type = other DNA
ggaaaagcgatcaagtgctgcagaagggat

SEQ ID NO: 3456 - DNA, 20 bp, synthetic construct
  misc_feature 1..20: note = Synthetic
  source 1..20: mol_type = other DNA
gtcaaccagtatcccggtgc

SEQ ID NO: 3457 - DNA, 20 bp, synthetic construct
  misc_feature 1..20: note = Synthetic
  source 1..20: mol_type = other DNA
gtcaaccagtatcccggtgc

SEQ ID NO: 3458 - DNA, 21 bp, synthetic construct
  misc_feature 1..21: note = Synthetic
  source 1..21: mol_type = other DNA
gtcaaccattaagcaaaacat

SEQ ID NO: 3459 - DNA, 20 bp, synthetic construct
  misc_feature 1..20: note = Synthetic
  source 1..20: mol_type = other DNA
ggggtcccaggtgctgacgt

SEQ ID NO: 3460 - DNA, 20 bp, synthetic construct
  misc_feature 1..20: note = Synthetic
  source 1..20: mol_type = other DNA
gacatcgatgtcctccccat

SEQ ID NO: 3461 - DNA, 21 bp, synthetic construct
  misc_feature 1..21: note = Synthetic
  source 1..21: mol_type = other DNA
gatgaagcactgtgggtacga

SEQ ID NO: 3462 - DNA, 21 bp, synthetic construct
  misc_feature 1..21: note = Synthetic
  source 1..21: mol_type = other DNA
gatgtacagagagcccagggc

SEQ ID NO: 3463 - DNA, 21 bp, synthetic construct
  misc_feature 1..21: note = Synthetic
  source 1..21: mol_type = other DNA
gcccttcagctaaaataaagg

SEQ ID NO: 3464 - DNA, 20 bp, synthetic construct
  misc_feature 1..20: note = Synthetic
  source 1..20: mol_type = other DNA
ggcccagactgagcacgtga

SEQ ID NO: 3465 - DNA, 20 bp, synthetic construct
  misc_feature 1..20: note = Synthetic
  source 1..20: mol_type = other DNA
ggcccagactgagcacgtga

SEQ ID NO: 3466 - DNA, 20 bp, synthetic construct
  misc_feature 1..20: note = Synthetic
  source 1..20: mol_type = other DNA
ggcccagactgagcacgtga

SEQ ID NO: 3467 - DNA, 20 bp, synthetic construct
  misc_feature 1..20: note = Synthetic
  source 1..20: mol_type = other DNA
ggaatcccttctgcagcacc

SEQ ID NO: 3468 - DNA, 20 bp, synthetic construct
  misc_feature 1..20: note = Synthetic
  source 1..20: mol_type = other DNA
ggaatcccttctgcagcacc

SEQ ID NO: 3469 - DNA, 20 bp, synthetic construct
  misc_feature 1..20: note = Synthetic
  source 1..20: mol_type = other DNA
ggaatcccttctgcagcacc

SEQ ID NO: 3470 - DNA, 20 bp, synthetic construct
  misc_feature 1..20: note = Synthetic
  source 1..20: mol_type = other DNA
gagtccgagcagaagaagaa

SEQ ID NO: 3471 - DNA, 20 bp, synthetic construct
  misc_feature 1..20: note = Synthetic
  source 1..20: mol_type = other DNA
gagtccgagcagaagaagaa

SEQ ID NO: 3472 - DNA, 20 bp, synthetic construct
  misc_feature 1..20: note = Synthetic
  source 1..20: mol_type = other DNA
gagtccgagcagaagaagaa

SEQ ID NO: 3473 - DNA, 20 bp, synthetic construct
  misc_feature 1..20: note = Synthetic
  source 1..20: mol_type = other DNA
gagtccgagcagaagaagaa

SEQ ID NO: 3474 - DNA, 20 bp, synthetic construct
  misc_feature 1..20: note = Synthetic
  source 1..20: mol_type = other DNA
gagtccgagcagaagaagaa

SEQ ID NO: 3475 - DNA, 20 bp, synthetic construct
  misc_feature 1..20: note = Synthetic
  source 1..20: mol_type = other DNA
gagtccgagcagaagaagaa

SEQ ID NO: 3476 - DNA, 20 bp, synthetic construct
  misc_feature 1..20: note = Synthetic
  source 1..20: mol_type = other DNA
gagtccgagcagaagaagaa

SEQ ID NO: 3477 - DNA, 20 bp, synthetic construct
  misc_feature 1..20: note = Synthetic
  source 1..20: mol_type = other DNA
ggcccagactgagcacgtga

SEQ ID NO: 3478 - DNA, 20 bp, synthetic construct
  misc_feature 1..20: note = Synthetic
  source 1..20: mol_type = other DNA
ggcccagactgagcacgtga

SEQ ID NO: 3479 - DNA, 23 bp, synthetic construct
  misc_feature 1..23: note = Synthetic
  source 1..23: mol_type = other DNA
tctgtcatcacgtgctcagtctg

SEQ ID NO: 3480 - DNA, 23 bp, synthetic construct
  misc_feature 1..23: note = Synthetic
  source 1..23: mol_type = other DNA
tctgctatcacgtgctcagtctg

SEQ ID NO: 3481 - DNA, 23 bp, synthetic construct
  misc_feature 1..23: note = Synthetic
  source 1..23: mol_type = other DNA
tctgccattacgtgctcagtctg

SEQ ID NO: 3482 - DNA, 31 bp, synthetic construct
  misc_feature 1..31: note = Synthetic
  source 1..31: mol_type = other DNA
ggaaaagtgatccaggtgctgcagaagggat

SEQ ID NO: 3483 - DNA, 31 bp, synthetic construct
  misc_feature 1..31: note = Synthetic
  source 1..31: mol_type = other DNA
ggaaaagcgattcaggtgctgcagaagggat

SEQ ID NO: 3484 - DNA, 31 bp, synthetic construct; identical to SEQ ID NO: 3358
  misc_feature 1..31: note = Synthetic
  source 1..31: mol_type = other DNA

SEQ ID NO: 3485 - DNA, 30 bp, synthetic construct
  misc_feature 1..30: note = Synthetic
  source 1..30: mol_type = other DNA
gtgatgggagtccttcttcttctgctcgga

SEQ ID NO: 3486 - DNA, 30 bp, synthetic construct; identical to SEQ ID NO: 3367
  misc_feature 1..30: note = Synthetic
  source 1..30: mol_type = other DNA

SEQ ID NO: 3487 - DNA, 30 bp, synthetic construct
  misc_feature 1..30: note = Synthetic
  source 1..30: mol_type = other DNA
gtgatgggagcctttcttcttctgctcgga

SEQ ID NO: 3488 - DNA, 30 bp, synthetic construct
  misc_feature 1..30: note = Synthetic
  source 1..30: mol_type = other DNA
gtgatgggagttcttcttcttctgctcgga

SEQ ID NO: 3489 - DNA, 30 bp, synthetic construct
  misc_feature 1..30: note = Synthetic
  source 1..30: mol_type = other DNA
gtgatgggagtctttcttcttctgctcgga

SEQ ID NO: 3490 - DNA, 30 bp, synthetic construct
  misc_feature 1..30: note = Synthetic
  source 1..30: mol_type = other DNA
gtgatgggagcttttcttcttctgctcgga

SEQ ID NO: 3491 - DNA, 30 bp, synthetic construct
  misc_feature 1..30: note = Synthetic
  source 1..30: mol_type = other DNA
gtgatgggagtttttcttcttctgctcgga

SEQ ID NO: 3492 - DNA, 23 bp, synthetic construct
  misc_feature 1..23: note = Synthetic
  source 1..23: mol_type = other DNA
tctgccgtcacgtgctcagtctg

SEQ ID NO: 3493 - DNA, 23 bp, synthetic construct
  misc_feature 1..23: note = Synthetic
  source 1..23: mol_type = other DNA
tctgccatcgcgtgctcagtctg

SEQ ID NO: 3494 - DNA, 20 bp, synthetic construct
  misc_feature 1..20: note = Synthetic
  source 1..20: mol_type = other DNA
ggcccagactgagcacgtga

SEQ ID NO: 3495 - DNA, 20 bp, synthetic construct
  misc_feature 1..20: note = Synthetic
  source 1..20: mol_type = other DNA
ggcccagactgagcacgtga

SEQ ID NO: 3496 - DNA, 20 bp, synthetic construct
  misc_feature 1..20: note = Synthetic
  source 1..20: mol_type = other DNA
gagtccgagcagaagaagaa

SEQ ID NO: 3497 - DNA, 20 bp, synthetic construct
  misc_feature 1..20: note = Synthetic
  source 1..20: mol_type = other DNA
gagtccgagcagaagaagaa

SEQ ID NO: 3498 - DNA, 20 bp, synthetic construct
  misc_feature 1..20: note = Synthetic
  source 1..20: mol_type = other DNA
ggaatcccttctgcagcacc

SEQ ID NO: 3499 - DNA, 20 bp, synthetic construct
  misc_feature 1..20: note = Synthetic
  source 1..20: mol_type = other DNA
ggaatcccttctgcagcacc

SEQ ID NO: 3500 - DNA, 20 bp, synthetic construct
  misc_feature 1..20: note = Synthetic
  source 1..20: mol_type = other DNA
ggcccagactgagcacgtga

SEQ ID NO: 3501 - DNA, 20 bp, synthetic construct
  misc_feature 1..20: note = Synthetic
  source 1..20: mol_type = other DNA
ggcccagactgagcacgtga

SEQ ID NO: 3502 - DNA, 20 bp, synthetic construct
  misc_feature 1..20: note = Synthetic
  source 1..20: mol_type = other DNA
ggcccagactgagcacgtga

SEQ ID NO: 3503 - DNA, 20 bp, synthetic construct
  misc_feature 1..20: note = Synthetic
  source 1..20: mol_type = other DNA
ggcccagactgagcacgtga

SEQ ID NO: 3504 - DNA, 20 bp, synthetic construct
  misc_feature 1..20: note = Synthetic
  source 1..20: mol_type = other DNA
ggcccagactgagcacgtga

SEQ ID NO: 3505 - DNA, 20 bp, synthetic construct
  misc_feature 1..20: note = Synthetic
  source 1..20: mol_type = other DNA
ggcccagactgagcacgtga

SEQ ID NO: 3506 - DNA, 21 bp, synthetic construct
  misc_feature 1..21: note = Synthetic
  source 1..21: mol_type = other DNA
gcatggtgcacctgactcctg

SEQ ID NO: 3507 - DNA, 21 bp, synthetic construct
  misc_feature 1..21: note = Synthetic
  source 1..21: mol_type = other DNA
gcatggtgcacctgactcctg

SEQ ID NO: 3508 - DNA, 21 bp, synthetic construct
  misc_feature 1..21: note = Synthetic
  source 1..21: mol_type = other DNA
gcatggtgcacctgactcctg

SEQ ID NO: 3509 - DNA, 21 bp, synthetic construct
  misc_feature 1..21: note = Synthetic
  source 1..21: mol_type = other DNA
gcatggtgcacctgactcctg

SEQ ID NO: 3510 - DNA, 21 bp, synthetic construct
  misc_feature 1..21: note = Synthetic
  source 1..21: mol_type = other DNA
gcatggtgcacctgactcctg

SEQ ID NO: 3511 - DNA, 21 bp, synthetic construct
  misc_feature 1..21: note = Synthetic
  source 1..21: mol_type = other DNA
gcatggtgcacctgactcctg

SEQ ID NO: 3512 - DNA, 21 bp, synthetic construct
  misc_feature 1..21: note = Synthetic
  source 1..21: mol_type = other DNA
gtacctgaaccgtatatccta

SEQ ID NO: 3513 - DNA, 21 bp, synthetic construct
  misc_feature 1..21: note = Synthetic
  source 1..21: mol_type = other DNA
gatccttccagtcagggccat

SEQ ID NO: 3514 - DNA, 21 bp, synthetic construct
  misc_feature 1..21: note = Synthetic
  source 1..21: mol_type = other DNA
gatccttccagtcagggccat

SEQ ID NO: 3515 - DNA, 20 bp, synthetic construct
  misc_feature 1..20: note = Synthetic
  source 1..20: mol_type = other DNA
gcagtggtggggggccttgg

SEQ ID NO: 3516 - DNA, 20 bp, synthetic construct
  misc_feature 1..20: note = Synthetic
  source 1..20: mol_type = other DNA
ggcccagactgagcacgtga

SEQ ID NO: 3517 - DNA, 20 bp, synthetic construct
  misc_feature 1..20: note = Synthetic
  source 1..20: mol_type = other DNA
ggcccagactgagcacgtga

SEQ ID NO: 3518 - DNA, 20 bp, synthetic construct
  misc_feature 1..20: note = Synthetic
  source 1..20: mol_type = other DNA
gtcatcttagtcattacctg

SEQ ID NO: 3519 - DNA, 21 bp, synthetic construct
  misc_feature 1..21: note = Synthetic
  source 1..21: mol_type = other DNA
gcatggtgcacctgactcctg

SEQ ID NO: 3520 - DNA, 20 bp, synthetic construct
  misc_feature 1..20: note = Synthetic
  source 1..20: mol_type = other DNA
ggcccagactgagcacgtga

SEQ ID NO: 3521 - DNA, 20 bp, synthetic construct
  misc_feature 1..20: note = Synthetic
  source 1..20: mol_type = other DNA
ggcccagactgagcacgtga

SEQ ID NO: 3522 - DNA, 23 bp, synthetic construct
  misc_feature 1..23: note = Synthetic
  source 1..23: mol_type = other DNA
tctgccatgacgtgctcagtctg

SEQ ID NO: 3523 - DNA, 26 bp, synthetic construct
  misc_feature 1..26: note = Synthetic
  source 1..26: mol_type = other DNA
atgggagcccttgttcttctgctcgg

SEQ ID NO: 3524 - DNA, 28 bp, synthetic construct
  misc_feature 1..28: note = Synthetic
  source 1..28: mol_type = other DNA
aaaagcgatcaaggtgctgcagaaggga

SEQ ID NO: 3525 - DNA, 65 bp, synthetic construct
  misc_feature 1..65: note = Synthetic
  source 1..65: mol_type = other DNA
tggaggaagcagggcttcctttcctctgccatcaatgatggtgatgatggtgcgtgctcagtctg

SEQ ID NO: 3526 - DNA, 23 bp, synthetic construct
  misc_feature 1..23: note = Synthetic
  source 1..23: mol_type = other DNA
tctgcaatcacgtgctcagtctg

SEQ ID NO: 3527 - DNA, 26 bp, synthetic construct
  misc_feature 1..26: note = Synthetic
  source 1..26: mol_type = other DNA
tctgccatcaaagcgtgctcagtctg

SEQ ID NO: 3528 - DNA, 27 bp, synthetic construct
  misc_feature 1..27: note = Synthetic
  source 1..27: mol_type = other DNA
agacttctccacaggagtcaggtgcac

SEQ ID NO: 3529 - DNA, 27 bp, synthetic construct
  misc_feature 1..27: note = Synthetic
  source 1..27: mol_type = other DNA
agacttctcctcaggagtcaggtgcac

SEQ ID NO: 3530 - DNA, 27 bp, synthetic construct
  misc_feature 1..27: note = Synthetic
  source 1..27: mol_type = other DNA
agacttctcttcaggagtcaggtgcac

SEQ ID NO: 3531 - DNA, 30 bp, synthetic construct
  misc_feature 1..30: note = Synthetic
  source 1..30: mol_type = other DNA
agtcagggccataggatagatatacggttc

SEQ ID NO: 3532 - DNA, 31 bp, synthetic construct
  misc_feature 1..31: note = Synthetic
  source 1..31: mol_type = other DNA
acctgaaccgtatatcctatggccctgactg

SEQ ID NO: 3533 - DNA, 32 bp, synthetic construct
  misc_feature 1..32: note = Synthetic
  source 1..32: mol_type = other DNA
gtacctgaaccgtatatcttatggccctgact

SEQ ID NO: 3534 - DNA, 24 bp, synthetic construct
  misc_feature 1..24: note = Synthetic
  source 1..24: mol_type = other DNA
atgtagacgccaaggccccccacc

SEQ ID NO: 3535 - DNA, 23 bp, synthetic construct
  misc_feature 1..23: note = Synthetic
  source 1..23: mol_type = other DNA
tctgccatcccgtgctcagtctg

SEQ ID NO: 3536 - DNA, 26 bp, synthetic construct
  misc_feature 1..26: note = Synthetic
  source 1..26: mol_type = other DNA
tctgccatcaaagcgtgctcagtctg

SEQ ID NO: 3537 - DNA, 29 bp, synthetic construct
  misc_feature 1..29: note = Synthetic
  source 1..29: mol_type = other DNA
aacgaacacctcacgtaatgactaagatg

SEQ ID NO: 3538 - DNA, 27 bp, synthetic construct
  misc_feature 1..27: note = Synthetic
  source 1..27: mol_type = other DNA
agacttctccacaggagtcaggtgcac

SEQ ID NO: 3539 - DNA, 65 bp, synthetic construct; identical to SEQ ID NO: 3525
  misc_feature 1..65: note = Synthetic
  source 1..65: mol_type = other DNA

SEQ ID NO: 3540 - DNA, 71 bp, synthetic construct
  misc_feature 1..71: note = Synthetic
  source 1..71: mol_type = other DNA
tggaggaagcagggcttcctttcctctgccatcacttatcgtcgtcatccttgtaatccgtgctcagtctg

SEQ ID NO: 3541 - DNA, 20 bp, synthetic construct
  misc_feature 1..20: note = Synthetic
  source 1..20: mol_type = other DNA
ggcccagactgagcacgtga

SEQ ID NO: 3542 - DNA, 20 bp, synthetic construct
  misc_feature 1..20: note = Synthetic
  source 1..20: mol_type = other DNA
ggcccagactgagcacgtga

SEQ ID NO: 3543 - DNA, 20 bp, synthetic construct
  misc_feature 1..20: note = Synthetic
  source 1..20: mol_type = other DNA
ggcccagactgagcacgtga

SEQ ID NO: 3544 - DNA, 20 bp, synthetic construct
  misc_feature 1..20: note = Synthetic
  source 1..20: mol_type = other DNA
ggcccagactgagcacgtga

SEQ ID NO: 3545 - DNA, 20 bp, synthetic construct
  misc_feature 1..20: note = Synthetic
  source 1..20: mol_type = other DNA
ggcccagactgagcacgtga

SEQ ID NO: 3546 - DNA, 20 bp, synthetic construct
  misc_feature 1..20: note = Synthetic
  source 1..20: mol_type = other DNA
gtcatcttagtcattacctg

SEQ ID NO: 3547 - DNA, 20 bp, synthetic construct
  misc_feature 1..20: note = Synthetic
  source 1..20: mol_type = other DNA
gagtccgagcagaagaagaa

SEQ ID NO: 3548 - DNA, 20 bp, synthetic construct
  misc_feature 1..20: note = Synthetic
  source 1..20: mol_type = other DNA
gtaacggcagacttctcctc

SEQ ID NO: 3549 - DNA, 22 bp, synthetic construct
  misc_feature 1..22: note = Synthetic
  source 1..22: mol_type = other DNA
tctgccatccgtgctcagtctg

SEQ ID NO: 3550 - DNA, 24 bp, synthetic construct
  misc_feature 1..24: note = Synthetic
  source 1..24: mol_type = other DNA
tctgccatcatcgtgctcagtctg

SEQ ID NO: 3551 - DNA, 26 bp, synthetic construct
  misc_feature 1..26: note = Synthetic
  source 1..26: mol_type = other DNA
tctgccatcaaagcgtgctcagtctg

SEQ ID NO: 3552 - DNA, 23 bp, synthetic construct
  misc_feature 1..23: note = Synthetic
  source 1..23: mol_type = other DNA
tctgccatgacgtgctcagtctg

SEQ ID NO: 3553 - DNA, 71 bp, synthetic construct; identical to SEQ ID NO: 3540
  misc_feature 1..71: note = Synthetic
  source 1..71: mol_type = other DNA

SEQ ID NO: 3554 - DNA, 29 bp, synthetic construct
  misc_feature 1..29: note = Synthetic
  source 1..29: mol_type = other DNA
aacgaacacctcatgtaatgactaagatg

SEQ ID NO: 3555 - DNA, 26 bp, synthetic construct
  misc_feature 1..26: note = Synthetic
  source 1..26: mol_type = other DNA
atgggagcccttgttcttctgctcgg

SEQ ID NO: 3556 - DNA, 26 bp, synthetic construct
  misc_feature 1..26: note = Synthetic
  source 1..26: mol_type = other DNA
atctgactcctgtggagaagtctgcc

SEQ ID NO: 3557 - DNA, 20 bp, synthetic construct
  misc_feature 1..20: note = Synthetic
  source 1..20: mol_type = other DNA
gatgtctgcaggccagatga

SEQ ID NO: 3558 - DNA, 20 bp, synthetic construct
  misc_feature 1..20: note = Synthetic
  source 1..20: mol_type = other DNA
gatgtctgcaggccagatga

SEQ ID NO: 3559 - DNA, 20 bp, synthetic construct
  misc_feature 1..20: note = Synthetic
  source 1..20: mol_type = other DNA
gatgtctgcaggccagatga

SEQ ID NO: 3560 - DNA, 20 bp, synthetic construct
  misc_feature 1..20: note = Synthetic
  source 1..20: mol_type = other DNA
gatgtctgcaggccagatga

SEQ ID NO: 3561 - DNA, 20 bp, synthetic construct
  misc_feature 1..20: note = Synthetic
  source 1..20: mol_type = other DNA
gatgtctgcaggccagatga

SEQ ID NO: 3562 - DNA, 20 bp, synthetic construct
  misc_feature 1..20: note = Synthetic
  source 1..20: mol_type = other DNA
gatgtctgcaggccagatga

SEQ ID NO: 3563 - DNA, 20 bp, synthetic construct
  misc_feature 1..20: note = Synthetic
  source 1..20: mol_type = other DNA
gatgtctgcaggccagatga

SEQ ID NO: 3564 - DNA, 20 bp, synthetic construct
  misc_feature 1..20: note = Synthetic
  source 1..20: mol_type = other DNA
gatgtctgcaggccagatga

SEQ ID NO: 3565 - DNA, 20 bp, synthetic construct
  misc_feature 1..20: note = Synthetic
  source 1..20: mol_type = other DNA
gatgtctgcaggccagatga

SEQ ID NO: 3566 - DNA, 20 bp, synthetic construct
  misc_feature 1..20: note = Synthetic
  source 1..20: mol_type = other DNA
gatgtctgcaggccagatga

SEQ ID NO: 3567 - DNA, 20 bp, synthetic construct
  misc_feature 1..20: note = Synthetic
  source 1..20: mol_type = other DNA
gatgtctgcaggccagatga

SEQ ID NO: 3568 - DNA, 20 bp, synthetic construct
  misc_feature 1..20: note = Synthetic
  source 1..20: mol_type = other DNA
gatgtctgcaggccagatga

SEQ ID NO: 3569 - DNA, 20 bp, synthetic construct
  misc_feature 1..20: note = Synthetic
  source 1..20: mol_type = other DNA
gatgtctgcaggccagatga

SEQ ID NO: 3570 - DNA, 20 bp, synthetic construct
  misc_feature 1..20: note = Synthetic
  source 1..20: mol_type = other DNA
gatgtctgcaggccagatga

SEQ ID NO: 3571 - DNA, 20 bp, synthetic construct
  misc_feature 1..20: note = Synthetic
  source 1..20: mol_type = other DNA
gatgtctgcaggccagatga

SEQ ID NO: 3572 - DNA, 20 bp, synthetic construct
  misc_feature 1..20: note = Synthetic
  source 1..20: mol_type = other DNA
gatgtctgcaggccagatga

SEQ ID NO: 3573 - DNA, 20 bp, synthetic construct
  misc_feature 1..20: note = Synthetic
  source 1..20: mol_type = other DNA
gatgtctgcaggccagatga

SEQ ID NO: 3574 - DNA, 20 bp, synthetic construct
  misc_feature 1..20: note = Synthetic
  source 1..20: mol_type = other DNA
gatgtctgcaggccagatga

SEQ ID NO: 3575 - DNA, 20 bp, synthetic construct
  misc_feature 1..20: note = Synthetic
  source 1..20: mol_type = other DNA
gatgtctgcaggccagatga

SEQ ID NO: 3576 - DNA, 20 bp, synthetic construct
  misc_feature 1..20: note = Synthetic
  source 1..20: mol_type = other DNA
gatgtctgcaggccagatga

SEQ ID NO: 3577 - DNA, 20 bp, synthetic construct
  misc_feature 1..20: note = Synthetic
  source 1..20: mol_type = other DNA
gatgtctgcaggccagatga

SEQ ID NO: 3578 - DNA, 20 bp, synthetic construct
  misc_feature 1..20: note = Synthetic
  source 1..20: mol_type = other DNA
gatgtctgcaggccagatga

SEQ ID NO: 3579 - DNA, 20 bp, synthetic construct
  misc_feature 1..20: note = Synthetic
  source 1..20: mol_type = other DNA
gatgtctgcaggccagatga

SEQ ID NO: 3580 - DNA, 20 bp, synthetic construct
  misc_feature 1..20: note = Synthetic
  source 1..20: mol_type = other DNA
gatgtctgcaggccagatga

SEQ ID NO: 3581 - DNA, 20 bp, synthetic construct
  misc_feature 1..20: note = Synthetic
  source 1..20: mol_type = other DNA
gattcctggtgccagaaaca

SEQ ID NO: 3582 - DNA, 20 bp, synthetic construct
  misc_feature 1..20: note = Synthetic
  source 1..20: mol_type = other DNA
gattcctggtgccagaaaca

SEQ ID NO: 3583 - DNA, 20 bp, synthetic construct
  misc_feature 1..20: note = Synthetic
  source 1..20: mol_type = other DNA
gattcctggtgccagaaaca

SEQ ID NO: 3584 - DNA, 20 bp, synthetic construct
  misc_feature 1..20: note = Synthetic
  source 1..20: mol_type = other DNA
gattcctggtgccagaaaca

SEQ ID NO: 3585 - DNA, 20 bp, synthetic construct
  misc_feature 1..20: note = Synthetic
  source 1..20: mol_type = other DNA
gattcctggtgccagaaaca

SEQ ID NO: 3586 - DNA, 20 bp, synthetic construct
  misc_feature 1..20: note = Synthetic
  source 1..20: mol_type = other DNA
gattcctggtgccagaaaca

SEQ ID NO: 3587 - DNA, 20 bp, synthetic construct
  misc_feature 1..20: note = Synthetic
  source 1..20: mol_type = other DNA
gattcctggtgccagaaaca

SEQ ID NO: 3588 - DNA, 20 bp, synthetic construct
  misc_feature 1..20: note = Synthetic
  source 1..20: mol_type = other DNA
gattcctggtgccagaaaca

SEQ ID NO: 3589 - DNA, 20 bp, synthetic construct
  misc_feature 1..20: note = Synthetic
  source 1..20: mol_type = other DNA
gattcctggtgccagaaaca

SEQ ID NO: 3590 - DNA, 20 bp, synthetic construct
  misc_feature 1..20: note = Synthetic
  source 1..20: mol_type = other DNA
gattcctggtgccagaaaca

SEQ ID NO: 3591 - DNA, 20 bp, synthetic construct
  misc_feature 1..20: note = Synthetic
  source 1..20: mol_type = other DNA
gattcctggtgccagaaaca

SEQ ID NO: 3592 - DNA, 20 bp, synthetic construct
  misc_feature 1..20: note = Synthetic
  source 1..20: mol_type = other DNA
gattcctggtgccagaaaca

SEQ ID NO: 3593 - DNA, 20 bp, synthetic construct
  misc_feature 1..20: note = Synthetic
  source 1..20: mol_type = other DNA
gattcctggtgccagaaaca

SEQ ID NO: 3594 - DNA, 20 bp, synthetic construct
  misc_feature 1..20: note = Synthetic
  source 1..20: mol_type = other DNA
gattcctggtgccagaaaca

SEQ ID NO: 3595 - DNA, 20 bp, synthetic construct
  misc_feature 1..20: note = Synthetic
  source 1..20: mol_type = other DNA
gattcctggtgccagaaaca

SEQ ID NO: 3596 - DNA, 20 bp, synthetic construct
  misc_feature 1..20: note = Synthetic
  source 1..20: mol_type = other DNA
gattcctggtgccagaaaca

SEQ ID NO: 3597 - DNA, 20 bp, synthetic construct
  misc_feature 1..20: note = Synthetic
  source 1..20: mol_type = other DNA
gattcctggtgccagaaaca

SEQ ID NO: 3598 - DNA, 20 bp, synthetic construct
  misc_feature 1..20: note = Synthetic
  source 1..20: mol_type = other DNA
gattcctggtgccagaaaca

SEQ ID NO: 3599 - DNA, 20 bp, synthetic construct
  misc_feature 1..20: note = Synthetic
  source 1..20: mol_type = other DNA
gattcctggtgccagaaaca

SEQ ID NO: 3600 - DNA, 20 bp, synthetic construct
  misc_feature 1..20: note = Synthetic
  source 1..20: mol_type = other DNA
gattcctggtgccagaaaca

SEQ ID NO: 3601 - DNA, 20 bp, synthetic construct
  misc_feature 1..20: note = Synthetic
  source 1..20: mol_type = other DNA
gattcctggtgccagaaaca

SEQ ID NO: 3602 - DNA, 20 bp, synthetic construct
  misc_feature 1..20: note = Synthetic
  source 1..20: mol_type = other DNA
gattcctggtgccagaaaca

SEQ ID NO: 3603 - DNA, 20 bp, synthetic construct
  misc_feature 1..20: note = Synthetic
  source 1..20: mol_type = other DNA
gattcctggtgccagaaaca

SEQ ID NO: 3604 - DNA, 20 bp, synthetic construct
  misc_feature 1..20: note = Synthetic
  source 1..20: mol_type = other DNA
gattcctggtgccagaaaca

SEQ ID NO: 3605 - DNA, 20 bp, synthetic construct
  misc_feature 1..20: note = Synthetic
  source 1..20: mol_type = other DNA
gcattttcaggaggaagcga

SEQ ID NO: 3606 - DNA, 20 bp, synthetic construct
  misc_feature 1..20: note = Synthetic
  source 1..20: mol_type = other DNA
gcattttcaggaggaagcga

SEQ ID NO: 3607 - DNA, 20 bp, synthetic construct
  misc_feature 1..20: note = Synthetic
  source 1..20: mol_type = other DNA
gcattttcaggaggaagcga

SEQ ID NO: 3608 - DNA, 20 bp, synthetic construct
  misc_feature 1..20: note = Synthetic
  source 1..20: mol_type = other DNA
gcattttcaggaggaagcga

SEQ ID NO: 3609 - DNA, 20 bp, synthetic construct
  misc_feature 1..20: note = Synthetic
  source 1..20: mol_type = other DNA
gcattttcaggaggaagcga

SEQ ID NO: 3610 - DNA, 20 bp, synthetic construct
  misc_feature 1..20: note = Synthetic
  source 1..20: mol_type = other DNA
gcattttcaggaggaagcga

SEQ ID NO: 3611 - DNA, 20 bp, synthetic construct
  misc_feature 1..20: note = Synthetic
  source 1..20: mol_type = other DNA
gcattttcaggaggaagcga

SEQ ID NO: 3612 - DNA, 20 bp, synthetic construct
  misc_feature 1..20: note = Synthetic
  source 1..20: mol_type = other DNA
gcattttcaggaggaagcga

SEQ ID NO: 3613 - DNA, 20 bp, synthetic construct
  misc_feature 1..20: note = Synthetic
  source 1..20: mol_type = other DNA
gcattttcaggaggaagcga

SEQ ID NO: 3614 - DNA, 20 bp, synthetic construct
  misc_feature 1..20: note = Synthetic
  source 1..20: mol_type = other DNA
gcattttcaggaggaagcga

SEQ ID NO: 3615 - DNA, 20 bp, synthetic construct
  misc_feature 1..20: note = Synthetic
  source 1..20: mol_type = other DNA
gcattttcaggaggaagcga

SEQ ID NO: 3616 - DNA, 20 bp, synthetic construct
  misc_feature 1..20: note = Synthetic
  source 1..20: mol_type = other DNA
gcattttcaggaggaagcga

SEQ ID NO: 3617 - DNA, 20 bp, synthetic construct
  misc_feature 1..20: note = Synthetic
  source 1..20: mol_type = other DNA
gcattttcaggaggaagcga

SEQ ID NO: 3618 - DNA, 20 bp, synthetic construct
  misc_feature 1..20: note = Synthetic
  source 1..20: mol_type = other DNA
gcattttcaggaggaagcga

SEQ ID NO: 3619 - DNA, 20 bp, synthetic construct
  misc_feature 1..20: note = Synthetic
  source 1..20: mol_type = other DNA
gcattttcaggaggaagcga

SEQ ID NO: 3620 - DNA, 20 bp, synthetic construct
  misc_feature 1..20: note = Synthetic
  source 1..20: mol_type = other DNA
gcattttcaggaggaagcga

SEQ ID NO: 3621 - DNA, 20 bp, synthetic construct
  misc_feature 1..20: note = Synthetic
  source 1..20: mol_type = other DNA
gcattttcaggaggaagcga

SEQ ID NO: 3622 - DNA, 20 bp, synthetic construct
  misc_feature 1..20: note = Synthetic
  source 1..20: mol_type = other DNA
gcattttcaggaggaagcga

SEQ ID NO: 3623 - DNA, 20 bp, synthetic construct
  misc_feature 1..20: note = Synthetic
  source 1..20: mol_type = other DNA
gcattttcaggaggaagcga

SEQ ID NO: 3624 - DNA, 20 bp, synthetic construct
  misc_feature 1..20: note = Synthetic
  source 1..20: mol_type = other DNA
gcattttcaggaggaagcga

SEQ ID NO: 3625 - DNA, 20 bp, synthetic construct
  misc_feature 1..20: note = Synthetic
  source 1..20: mol_type = other DNA
gcattttcaggaggaagcga

SEQ ID NO: 3626 - DNA, 20 bp, synthetic construct
  misc_feature 1..20: note = Synthetic
  source 1..20: mol_type = other DNA
gcattttcaggaggaagcga

SEQ ID NO: 3627 - DNA, 20 bp, synthetic construct
  misc_feature 1..20: note = Synthetic
  source 1..20: mol_type = other DNA
gcattttcaggaggaagcga

SEQ ID NO: 3628 - DNA, 44 bp, synthetic construct
  misc_feature 1..44: note = Synthetic
  source 1..44: mol_type = other DNA
ccctctgacaatgtgccatctggagcactcatctggcctgcaga

SEQ ID NO: 3629 - DNA, 43 bp, synthetic construct
  misc_feature 1..43: note = Synthetic
  source 1..43: mol_type = other DNA
cctctgacaatgtgccatctggagcactcatctggcctgcaga

SEQ ID NO: 3630 - DNA, 42 bp, synthetic construct
  misc_feature 1..42: note = Synthetic
  source 1..42: mol_type = other DNA
ctctgacaatgtgccatctggagcactcatctggcctgcaga

SEQ ID NO: 3631 - DNA, 41 bp, synthetic construct
  misc_feature 1..41: note = Synthetic
  source 1..41: mol_type = other DNA
tctgacaatgtgccatctggagcactcatctggcctgcaga

SEQ ID NO: 3632 - DNA, 40 bp, synthetic construct
  misc_feature 1..40: note = Synthetic
  source 1..40: mol_type = other DNA
ctgacaatgtgccatctggagcactcatctggcctgcaga

SEQ ID NO: 3633 - DNA, 39 bp, synthetic construct
  misc_feature 1..39: note = Synthetic
  source 1..39: mol_type = other DNA
tgacaatgtgccatctggagcactcatctggcctgcaga

SEQ ID NO: 3634 - DNA, 38 bp, synthetic construct
  misc_feature 1..38: note = Synthetic
  source 1..38: mol_type = other DNA
gacaatgtgccatctggagcactcatctggcctgcaga

SEQ ID NO: 3635 - DNA, 37 bp, synthetic construct
  misc_feature 1..37: note = Synthetic
  source 1..37: mol_type = other DNA
acaatgtgccatctggagcactcatctggcctgcaga

SEQ ID NO: 3636 - DNA, 36 bp, synthetic construct
  misc_feature 1..36: note = Synthetic
  source 1..36: mol_type = other DNA
caatgtgccatctggagcactcatctggcctgcaga

SEQ ID NO: 3637 - DNA, 35 bp, synthetic construct; identical to SEQ ID NO: 3394
  misc_feature 1..35: note = Synthetic
  source 1..35: mol_type = other DNA

SEQ ID NO: 3638 - DNA, 34 bp, synthetic construct
  misc_feature 1..34: note = Synthetic
  source 1..34: mol_type = other DNA
atgtgccatctggagcactcatctggcctgcaga

SEQ ID NO: 3639 - DNA, 33 bp, synthetic construct
  misc_feature 1..33: note = Synthetic
  source 1..33: mol_type = other DNA
tgtgccatctggagcactcatctggcctgcaga

SEQ ID NO: 3640 - DNA, 32 bp, synthetic construct
  misc_feature 1..32: note = Synthetic
  source 1..32: mol_type = other DNA
gtgccatctggagcactcatctggcctgcaga

SEQ ID NO: 3641 - DNA, 31 bp, synthetic construct
  misc_feature 1..31: note = Synthetic
  source 1..31: mol_type = other DNA
tgccatctggagcactcatctggcctgcaga

SEQ ID NO: 3642 - DNA, 30 bp, synthetic construct
  misc_feature 1..30: note = Synthetic
  source 1..30: mol_type = other DNA
gccatctggagcactcatctggcctgcaga

SEQ ID NO: 3643 - DNA, 29 bp, synthetic construct
  misc_feature 1..29: note = Synthetic
  source 1..29: mol_type = other DNA
ccatctggagcactcatctggcctgcaga

SEQ ID NO: 3644 - DNA, 28 bp, synthetic construct
  misc_feature 1..28: note = Synthetic
  source 1..28: mol_type = other DNA
catctggagcactcatctggcctgcaga

SEQ ID NO: 3645 - DNA, 27 bp, synthetic construct
  misc_feature 1..27: note = Synthetic
  source 1..27: mol_type = other DNA
atctggagcactcatctggcctgcaga

SEQ ID NO: 3646 - DNA, 26 bp, synthetic construct
  misc_feature 1..26: note = Synthetic
  source 1..26: mol_type = other DNA
tctggagcactcatctggcctgcaga

SEQ ID NO: 3647 - DNA, 25 bp, synthetic construct
  misc_feature 1..25: note = Synthetic
  source 1..25: mol_type = other DNA
ctggagcactcatctggcctgcaga

SEQ ID NO: 3648 - DNA, 24 bp, synthetic construct
  misc_feature 1..24: note = Synthetic
  source 1..24: mol_type = other DNA
tggagcactcatctggcctgcaga

SEQ ID NO: 3649 - DNA, 23 bp, synthetic construct
  misc_feature 1..23: note = Synthetic
  source 1..23: mol_type = other DNA
ggagcactcatctggcctgcaga

SEQ ID NO: 3650 - DNA, 22 bp, synthetic construct
  misc_feature 1..22: note = Synthetic
  source 1..22: mol_type = other DNA
gagcactcatctggcctgcaga

SEQ ID NO: 3651 - DNA, 21 bp, synthetic construct
  misc_feature 1..21: note = Synthetic
  source 1..21: mol_type = other DNA
agcactcatctggcctgcaga

SEQ ID NO: 3652 - DNA, 44 bp, synthetic construct
  misc_feature 1..44: note = Synthetic
  source 1..44: mol_type = other DNA
aggactagttctgccctcccgtcaccactgtttctggcaccagg

SEQ ID NO: 3653 - DNA, 43 bp, synthetic construct
  misc_feature 1..43: note = Synthetic
  source 1..43: mol_type = other DNA
ggactagttctgccctcccgtcaccactgtttctggcaccagg

SEQ ID NO: 3654 - DNA, 42 bp, synthetic construct
  misc_feature 1..42: note = Synthetic
  source 1..42: mol_type = other DNA
gactagttctgccctcccgtcaccactgtttctggcaccagg

SEQ ID NO: 3655 - DNA, 41 bp, synthetic construct
  misc_feature 1..41: note = Synthetic
  source 1..41: mol_type = other DNA
actagttctgccctcccgtcaccactgtttctggcaccagg

SEQ ID NO: 3656 - DNA, 40 bp, synthetic construct
  misc_feature 1..40: note = Synthetic
  source 1..40: mol_type = other DNA
ctagttctgccctcccgtcaccactgtttctggcaccagg

SEQ ID NO: 3657 - DNA, 39 bp, synthetic construct
  misc_feature 1..39: note = Synthetic
  source 1..39: mol_type = other DNA
tagttctgccctcccgtcaccactgtttctggcaccagg

SEQ ID NO: 3658 - DNA, 38 bp, synthetic construct
  misc_feature 1..38: note = Synthetic
  source 1..38: mol_type = other DNA
agttctgccctcccgtcaccactgtttctggcaccagg

SEQ ID NO: 3659 - DNA, 37 bp, synthetic construct
  misc_feature 1..37: note = Synthetic
  source 1..37: mol_type = other DNA
gttctgccctcccgtcaccactgtttctggcaccagg

SEQ ID NO: 3660 - DNA, 36 bp, synthetic construct
  misc_feature 1..36: note = Synthetic
  source 1..36: mol_type = other DNA
ttctgccctcccgtcaccactgtttctggcaccagg

SEQ ID NO: 3661 - DNA, 35 bp, synthetic construct
  misc_feature 1..35: note = Synthetic
  source 1..35: mol_type = other DNA
tctgccctcccgtcaccactgtttctggcaccagg

SEQ ID NO: 3662 - DNA, 34 bp, synthetic construct
  misc_feature 1..34: note = Synthetic
  source 1..34: mol_type = other DNA
ctgccctcccgtcaccactgtttctggcaccagg

SEQ ID NO: 3663 - DNA, 33 bp, synthetic construct
  misc_feature 1..33: note = Synthetic
  source 1..33: mol_type = other DNA
tgccctcccgtcaccactgtttctggcaccagg

SEQ ID NO: 3664 - DNA, 32 bp, synthetic construct
  misc_feature 1..32: note = Synthetic
  source 1..32: mol_type = other DNA
gccctcccgtcaccactgtttctggcaccagg

SEQ ID NO: 3665 - DNA, 31 bp, synthetic construct
  misc_feature 1..31: note = Synthetic
  source 1..31: mol_type = other DNA
ccctcccgtcaccactgtttctggcaccagg

SEQ ID NO: 3666 - DNA, 30 bp, synthetic construct
  misc_feature 1..30: note = Synthetic
  source 1..30: mol_type = other DNA
cctcccgtcaccactgtttctggcaccagg

SEQ ID NO: 3667 - DNA, 29 bp, synthetic construct
  misc_feature 1..29: note = Synthetic
  source 1..29: mol_type = other DNA
ctcccgtcaccactgtttctggcaccagg

SEQ ID NO: 3668 - DNA, 28 bp, synthetic construct
  misc_feature 1..28: note = Synthetic
  source 1..28: mol_type = other DNA
tcccgtcaccactgtttctggcaccagg

SEQ ID NO: 3669 - DNA, 27 bp, synthetic construct
  misc_feature 1..27: note = Synthetic
  source 1..27: mol_type = other DNA
cccgtcaccactgtttctggcaccagg

SEQ ID NO: 3670 - DNA, 26 bp, synthetic construct
  misc_feature 1..26: note = Synthetic
  source 1..26: mol_type = other DNA
ccgtcaccactgtttctggcaccagg

SEQ ID NO: 3671 - DNA, 25 bp, synthetic construct
  misc_feature 1..25: note = Synthetic
  source 1..25: mol_type = other DNA
cgtcaccactgtttctggcaccagg

SEQ ID NO: 3672 - DNA, 24 bp, synthetic construct
  misc_feature 1..24: note = Synthetic
  source 1..24: mol_type = other DNA
gtcaccactgtttctggcaccagg

SEQ ID NO: 3673 - DNA, 23 bp, synthetic construct
  misc_feature 1..23: note = Synthetic
  source 1..23: mol_type = other DNA
tcaccactgtttctggcaccagg

SEQ ID NO: 3674 - DNA, 22 bp, synthetic construct
  misc_feature 1..22: note = Synthetic
  source 1..22: mol_type = other DNA
caccactgtttctggcaccagg

SEQ ID NO: 3675 - DNA, 21 bp, synthetic construct
  misc_feature 1..21: note = Synthetic
  source 1..21: mol_type = other DNA
accactgtttctggcaccagg

SEQ ID NO: 3676 - DNA, 46 bp, synthetic construct
  misc_feature 1..46: note = Synthetic
  source 1..46: mol_type = other DNA
aatgactcaaatatgctgtctgaagcaatcgcttcctcctgaaaat

SEQ ID NO: 3677 - DNA, 45 bp, synthetic construct
  misc_feature 1..45: note = Synthetic
  source 1..45: mol_type = other DNA
atgactcaaatatgctgtctgaagcaatcgcttcctcctgaaaat

SEQ ID NO: 3678 - DNA, 44 bp, synthetic construct
  misc_feature 1..44: note = Synthetic
  source 1..44: mol_type = other DNA
tgactcaaatatgctgtctgaagcaatcgcttcctcctgaaaat

SEQ ID NO: 3679 - DNA, 43 bp, synthetic construct
  misc_feature 1..43: note = Synthetic
  source 1..43: mol_type = other DNA
gactcaaatatgctgtctgaagcaatcgcttcctcctgaaaat

SEQ ID NO: 3680 - DNA, 42 bp, synthetic construct
  misc_feature 1..42: note = Synthetic
  source 1..42: mol_type = other DNA
actcaaatatgctgtctgaagcaatcgcttcctcctgaaaat

SEQ ID NO: 3681 - DNA, 41 bp, synthetic construct
  misc_feature 1..41: note = Synthetic
  source 1..41: mol_type = other DNA
ctcaaatatgctgtctgaagcaatcgcttcctcctgaaaat

SEQ ID NO: 3682 - DNA, 40 bp, synthetic construct
  misc_feature 1..40: note = Synthetic
  source 1..40: mol_type = other DNA
tcaaatatgctgtctgaagcaatcgcttcctcctgaaaat

SEQ ID NO: 3683 - DNA, 39 bp, synthetic construct
  misc_feature 1..39: note = Synthetic
  source 1..39: mol_type = other DNA
caaatatgctgtctgaagcaatcgcttcctcctgaaaat

SEQ ID NO: 3684 - DNA, 38 bp, synthetic construct
  misc_feature 1..38: note = Synthetic
  source 1..38: mol_type = other DNA
aaatatgctgtctgaagcaatcgcttcctcctgaaaat

SEQ ID NO: 3685 - DNA, 37 bp, synthetic construct
  misc_feature 1..37: note = Synthetic
  source 1..37: mol_type = other DNA
aatatgctgtctgaagcaatcgcttcctcctgaaaat

SEQ ID NO: 3686 - DNA, 36 bp, synthetic construct
  misc_feature 1..36: note = Synthetic
  source 1..36: mol_type = other DNA
atatgctgtctgaagcaatcgcttcctcctgaaaat

SEQ ID NO: 3687 - DNA, 35 bp, synthetic construct
  misc_feature 1..35: note = Synthetic
  source 1..35: mol_type = other DNA
tatgctgtctgaagcaatcgcttcctcctgaaaat

SEQ ID NO: 3688 - DNA, 34 bp, synthetic construct
  misc_feature 1..34: note = Synthetic
  source 1..34: mol_type = other DNA
atgctgtctgaagcaatcgcttcctcctgaaaat

SEQ ID NO: 3689 - DNA, 33 bp, synthetic construct
  misc_feature 1..33: note = Synthetic
  source 1..33: mol_type = other DNA
tgctgtctgaagcaatcgcttcctcctgaaaat

SEQ ID NO: 3690 - DNA, 32 bp, synthetic construct
  misc_feature 1..32: note = Synthetic
  source 1..32: mol_type = other DNA
gctgtctgaagcaatcgcttcctcctgaaaat

SEQ ID NO: 3691 - DNA, 31 bp, synthetic construct
  misc_feature 1..31: note = Synthetic
  source 1..31: mol_type = other DNA
ctgtctgaagcaatcgcttcctcctgaaaat

SEQ ID NO: 3692 - DNA, 30 bp, synthetic construct; identical to SEQ ID NO: 3385
  misc_feature 1..30: note = Synthetic
  source 1..30: mol_type = other DNA

SEQ ID NO: 3693 - DNA, 29 bp, synthetic construct
  misc_feature 1..29: note = Synthetic
  source 1..29: mol_type = other DNA
gtctgaagcaatcgcttcctcctgaaaat

SEQ ID NO: 3694 - DNA, 28 bp, synthetic construct
  misc_feature 1..28: note = Synthetic
  source 1..28: mol_type = other DNA
tctgaagcaatcgcttcctcctgaaaat

SEQ ID NO: 3695 - DNA, 27 bp, synthetic construct
  misc_feature 1..27: note = Synthetic
  source 1..27: mol_type = other DNA
ctgaagcaatcgcttcctcctgaaaat

SEQ ID NO: 3696 - DNA, 26 bp, synthetic construct
  misc_feature 1..26: note = Synthetic
  source 1..26: mol_type = other DNA
tgaagcaatcgcttcctcctgaaaat

SEQ ID NO: 3697 - DNA, 25 bp, synthetic construct
  misc_feature 1..25: note = Synthetic
  source 1..25: mol_type = other DNA
gaagcaatcgcttcctcctgaaaat

SEQ ID NO: 3698 - DNA, 24 bp, synthetic construct
  misc_feature 1..24: note = Synthetic
  source 1..24: mol_type = other DNA
aagcaatcgcttcctcctgaaaat

SEQ ID NO: 3699 - DNA, 20 bp, synthetic construct
  misc_feature 1..20: note = Synthetic
  source 1..20: mol_type = other DNA
gtaacggcagacttctccac

SEQ ID NO: 3700 - DNA, 21 bp, synthetic construct
  misc_feature 1..21: note = Synthetic
  source 1..21: mol_type = other DNA
gcatggtgcacctgactcctg

SEQ ID NO: 3701 - DNA, 21 bp, synthetic construct
  misc_feature 1..21: note = Synthetic
  source 1..21: mol_type = other DNA
gcatggtgcacctgactcctg

SEQ ID NO: 3702 - DNA, 21 bp, synthetic construct
  misc_feature 1..21: note = Synthetic
  source 1..21: mol_type = other DNA
gcatggtgcacctgactcctg

SEQ ID NO: 3703 - DNA, 21 bp, synthetic construct
  misc_feature 1..21: note = Synthetic
  source 1..21: mol_type = other DNA
gcatggtgcacctgactcctg

SEQ ID NO: 3704 - DNA, 21 bp, synthetic construct
  misc_feature 1..21: note = Synthetic
  source 1..21: mol_type = other DNA
gcatggtgcacctgactcctg

SEQ ID NO: 3705 - DNA, 21 bp, synthetic construct
  misc_feature 1..21: note = Synthetic
  source 1..21: mol_type = other DNA
gcatggtgcacctgactcctg

SEQ ID NO: 3706 - DNA, 21 bp, synthetic construct
  misc_feature 1..21: note = Synthetic
  source 1..21: mol_type = other DNA
gcatggtgcacctgactcctg

SEQ ID NO: 3707 - DNA, 21 bp, synthetic construct
  misc_feature 1..21: note = Synthetic
  source 1..21: mol_type = other DNA
gcatggtgcacctgactcctg

SEQ ID NO: 3708 - DNA, 21 bp, synthetic construct
  misc_feature 1..21: note = Synthetic
  source 1..21: mol_type = other DNA
gcatggtgcacctgactcctg

SEQ ID NO: 3709 - DNA, 21 bp, synthetic construct
  misc_feature 1..21: note = Synthetic
  source 1..21: mol_type = other DNA
gcatggtgcacctgactcctg

SEQ ID NO: 3710 - DNA, 21 bp, synthetic construct
  misc_feature 1..21: note = Synthetic
  source 1..21: mol_type = other DNA
gcatggtgcacctgactcctg

SEQ ID NO: 3711 - DNA, 21 bp, synthetic construct
  misc_feature 1..21: note = Synthetic
  source 1..21: mol_type = other DNA
gcatggtgcacctgactcctg

SEQ ID NO: 3712 - DNA, 21 bp, synthetic construct
  misc_feature 1..21: note = Synthetic
  source 1..21: mol_type = other DNA
gcatggtgcacctgactcctg

SEQ ID NO: 3713 - DNA, 20 bp, synthetic construct
  misc_feature 1..20: note = Synthetic
  source 1..20: mol_type = other DNA
atccttccagtcagggccat

SEQ ID NO: 3714 - DNA, 20 bp, synthetic construct
  misc_feature 1..20: note = Synthetic
  source 1..20: mol_type = other DNA
atccttccagtcagggccat

SEQ ID NO: 3715 - DNA, 20 bp, synthetic construct
  misc_feature 1..20: note = Synthetic
  source 1..20: mol_type = other DNA
atccttccagtcagggccat

SEQ ID NO: 3716 - DNA, 20 bp, synthetic construct
  misc_feature 1..20: note = Synthetic
  source 1..20: mol_type = other DNA
atccttccagtcagggccat

SEQ ID NO: 3717 - DNA, 20 bp, synthetic construct
  misc_feature 1..20: note = Synthetic
  source 1..20: mol_type = other DNA
atccttccagtcagggccat

SEQ ID NO: 3718 - DNA, 20 bp, synthetic construct
  misc_feature 1..20: note = Synthetic
  source 1..20: mol_type = other DNA
atccttccagtcagggccat

SEQ ID NO: 3719 - DNA, 20 bp, synthetic construct
  misc_feature 1..20: note = Synthetic
  source 1..20: mol_type = other DNA
atccttccagtcagggccat

SEQ ID NO: 3720 - DNA, 20 bp, synthetic construct
  misc_feature 1..20: note = Synthetic
  source 1..20: mol_type = other DNA
atccttccagtcagggccat

SEQ ID NO: 3721 - DNA, 20 bp, synthetic construct
  misc_feature 1..20: note = Synthetic
  source 1..20: mol_type = other DNA
atccttccagtcagggccat

SEQ ID NO: 3722 - DNA, 20 bp, synthetic construct
  misc_feature 1..20: note = Synthetic
  source 1..20: mol_type = other DNA
atccttccagtcagggccat

SEQ ID NO: 3723 - DNA, 20 bp, synthetic construct
  misc_feature 1..20: note = Synthetic
  source 1..20: mol_type = other DNA
atccttccagtcagggccat

SEQ ID NO: 3724 - DNA, 20 bp, synthetic construct
  misc_feature 1..20: note = Synthetic
  source 1..20: mol_type = other DNA
atccttccagtcagggccat

SEQ ID NO: 3725 - DNA, 20 bp, synthetic construct
  misc_feature 1..20: note = Synthetic
  source 1..20: mol_type = other DNA
atccttccagtcagggccat

SEQ ID NO: 3726 - DNA, 20 bp, synthetic construct
  misc_feature 1..20: note = Synthetic
  source 1..20: mol_type = other DNA
atccttccagtcagggccat

SEQ ID NO: 3727 - DNA, 20 bp, synthetic construct
  misc_feature 1..20: note = Synthetic
  source 1..20: mol_type = other DNA
atccttccagtcagggccat

SEQ ID NO: 3728 - DNA, 20 bp, synthetic construct
  misc_feature 1..20: note = Synthetic
  source 1..20: mol_type = other DNA
atccttccagtcagggccat

SEQ ID NO: 3729 - DNA, 20 bp, synthetic construct
  misc_feature 1..20: note = Synthetic
  source 1..20: mol_type = other DNA
atccttccagtcagggccat

SEQ ID NO: 3730 - DNA, 20 bp, synthetic construct
  misc_feature 1..20: note = Synthetic
  source 1..20: mol_type = other DNA
atccttccagtcagggccat

SEQ ID NO: 3731 - DNA, 20 bp, synthetic construct
  misc_feature 1..20: note = Synthetic
  source 1..20: mol_type = other DNA
atccttccagtcagggccat

SEQ ID NO: 3732 - DNA, 20 bp, synthetic construct
  misc_feature 1..20: note = Synthetic
  source 1..20: mol_type = other DNA
atccttccagtcagggccat

SEQ ID NO: 3733 - DNA, 20 bp, synthetic construct
  misc_feature 1..20: note = Synthetic
  source 1..20: mol_type = other DNA
atccttccagtcagggccat

SEQ ID NO: 3734 - DNA, 20 bp, synthetic construct
  misc_feature 1..20: note = Synthetic
  source 1..20: mol_type = other DNA
atccttccagtcagggccat

SEQ ID NO: 3735 - DNA, 20 bp, synthetic construct
  misc_feature 1..20: note = Synthetic
  source 1..20: mol_type = other DNA
atccttccagtcagggccat

SEQ ID NO: 3736 - DNA, 20 bp, synthetic construct
  misc_feature 1..20: note = Synthetic
  source 1..20: mol_type = other DNA
atccttccagtcagggccat

SEQ ID NO: 3737 - DNA, 20 bp, synthetic construct
  misc_feature 1..20: note = Synthetic
  source 1..20: mol_type = other DNA
atccttccagtcagggccat

SEQ ID NO: 3738 - DNA, 20 bp, synthetic construct
  misc_feature 1..20: note = Synthetic
  source 1..20: mol_type = other DNA
atccttccagtcagggccat

SEQ ID NO: 3739 - DNA, 20 bp, synthetic construct
  misc_feature 1..20: note = Synthetic
  source 1..20: mol_type = other DNA
atccttccagtcagggccat

SEQ ID NO: 3740 - DNA, 20 bp, synthetic construct
  misc_feature 1..20: note = Synthetic
  source 1..20: mol_type = other DNA
atccttccagtcagggccat

SEQ ID NO: 3741 - DNA, 20 bp, synthetic construct
  misc_feature 1..20: note = Synthetic
  source 1..20: mol_type = other DNA
atccttccagtcagggccat

SEQ ID NO: 3742 - DNA, 20 bp, synthetic construct
  misc_feature 1..20: note = Synthetic
  source 1..20: mol_type = other DNA
atccttccagtcagggccat

SEQ ID NO: 3743 - DNA, 20 bp, synthetic construct
  misc_feature 1..20: note = Synthetic
  source 1..20: mol_type = other DNA
atccttccagtcagggccat

SEQ ID NO: 3744 - DNA, 20 bp, synthetic construct
  misc_feature 1..20: note = Synthetic
  source 1..20: mol_type = other DNA
atccttccagtcagggccat

SEQ ID NO: 3745 - DNA, 20 bp, synthetic construct
  misc_feature 1..20: note = Synthetic
  source 1..20: mol_type = other DNA
atccttccagtcagggccat

SEQ ID NO: 3746 - DNA, 20 bp, synthetic construct
  misc_feature 1..20: note = Synthetic
  source 1..20: mol_type = other DNA
atccttccagtcagggccat

SEQ ID NO: 3747 - DNA, 20 bp, synthetic construct
  misc_feature 1..20: note = Synthetic
  source 1..20: mol_type = other DNA
atccttccagtcagggccat

SEQ ID NO: 3748 - DNA, 20 bp, synthetic construct
  misc_feature 1..20: note = Synthetic
  source 1..20: mol_type = other DNA
atccttccagtcagggccat

SEQ ID NO: 3749 - DNA, 20 bp, synthetic construct
  misc_feature 1..20: note = Synthetic
  source 1..20: mol_type = other DNA
atccttccagtcagggccat

SEQ ID NO: 3750 - DNA, 20 bp, synthetic construct
  misc_feature 1..20: note = Synthetic
  source 1..20: mol_type = other DNA
atccttccagtcagggccat

SEQ ID NO: 3751 - DNA, 20 bp, synthetic construct
  misc_feature 1..20: note = Synthetic
  source 1..20: mol_type = other DNA
atccttccagtcagggccat

SEQ ID NO: 3752 - DNA, 20 bp, synthetic construct
  misc_feature 1..20: note = Synthetic
  source 1..20: mol_type = other DNA
atccttccagtcagggccat

SEQ ID NO: 3753 - DNA, 20 bp, synthetic construct
  misc_feature 1..20: note = Synthetic
  source 1..20: mol_type = other DNA
atccttccagtcagggccat

SEQ ID NO: 3754 - DNA, 20 bp, synthetic construct
  misc_feature 1..20: note = Synthetic
  source 1..20: mol_type = other DNA
atccttccagtcagggccat

SEQ ID NO: 3755 - DNA, 27 bp, synthetic construct
  misc_feature 1..27: note = Synthetic
  source 1..27: mol_type = other DNA
agacttctcctcaggagtcaggtgcac

SEQ ID NO: 3756 - DNA, 27 bp, synthetic construct
  misc_feature 1..27: note = Synthetic
  source 1..27: mol_type = other DNA
agacttctcttcaggagtcaggtgcac

SEQ ID NO: 3757 - DNA, 34 bp, synthetic construct
  misc_feature 1..34: note = Synthetic
  source 1..34: mol_type = other DNA
taacggcagacttctcctcaggagtcaggtgcac

SEQ ID NO: 3758 - DNA, 32 bp, synthetic construct
  misc_feature 1..32: note = Synthetic
  source 1..32: mol_type = other DNA
acggcagacttctcctcaggagtcaggtgcac

SEQ ID NO: 3759 - DNA, 30 bp, synthetic construct
  misc_feature 1..30: note = Synthetic
  source 1..30: mol_type = other DNA
ggcagacttctcctcaggagtcaggtgcac

SEQ ID NO: 3760 - DNA, 29 bp, synthetic construct
  misc_feature 1..29: note = Synthetic
  source 1..29: mol_type = other DNA
gcagacttctcctcaggagtcaggtgcac

SEQ ID NO: 3761 - DNA, 26 bp, synthetic construct
  misc_feature 1..26: note = Synthetic
  source 1..26: mol_type = other DNA
gacttctcctcaggagtcaggtgcac

SEQ ID NO: 3762 - DNA, 25 bp, synthetic construct
  misc_feature 1..25: note = Synthetic
  source 1..25: mol_type = other DNA
acttctcctcaggagtcaggtgcac

SEQ ID NO: 3763 - DNA, 33 bp, synthetic construct
  misc_feature 1..33: note = Synthetic
  source 1..33: mol_type = other DNA
taacggcagacttctcctcaggagtcaggtgca

SEQ ID NO: 3764 - DNA, 31 bp, synthetic construct
  misc_feature 1..31: note = Synthetic
  source 1..31: mol_type = other DNA
acggcagacttctcctcaggagtcaggtgca

SEQ ID NO: 3765 - DNA, 29 bp, synthetic construct
  misc_feature 1..29: note = Synthetic
  source 1..29: mol_type = other DNA
ggcagacttctcctcaggagtcaggtgca

SEQ ID NO: 3766 - DNA, 28 bp, synthetic construct
  misc_feature 1..28: note = Synthetic
  source 1..28: mol_type = other DNA
gcagacttctcctcaggagtcaggtgca

SEQ ID NO: 3767 - DNA, 25 bp, synthetic construct
  misc_feature 1..25: note = Synthetic
  source 1..25: mol_type = other DNA
gacttctcctcaggagtcaggtgca

SEQ ID NO: 3768 - DNA, 24 bp, synthetic construct
  misc_feature 1..24: note = Synthetic
  source 1..24: mol_type = other DNA
acttctcctcaggagtcaggtgca

SEQ ID NO: 3769 - DNA, 23 bp, synthetic construct
  misc_feature 1..23: note = Synthetic
  source 1..23: mol_type = other DNA
atatcttatggccctgactggaa

SEQ ID NO: 3770 - DNA, 24 bp, synthetic construct
  misc_feature 1..24: note = Synthetic
  source 1..24: mol_type = other DNA
tatatcttatggccctgactggaa

SEQ ID NO: 3771 - DNA, 25 bp, synthetic construct
  misc_feature 1..25: note = Synthetic
  source 1..25: mol_type = other DNA
gtatatcttatggccctgactggaa

SEQ ID NO: 3772 - DNA, 28 bp, synthetic construct
  misc_feature 1..28: note = Synthetic
  source 1..28: mol_type = other DNA
accgtatatcttatggccctgactggaa

SEQ ID NO: 3773 - DNA, 29 bp, synthetic construct
  misc_feature 1..29: note = Synthetic
  source 1..29: mol_type = other DNA
aaccgtatatcttatggccctgactggaa

SEQ ID NO: 3774 - DNA, 30 bp, synthetic construct
  misc_feature 1..30: note = Synthetic
  source 1..30: mol_type = other DNA
gaaccgtatatcttatggccctgactggaa

SEQ ID NO: 3775 - DNA, 31 bp, synthetic construct
  misc_feature 1..31: note = Synthetic
  source 1..31: mol_type = other DNA
tgaaccgtatatcttatggccctgactggaa

SEQ ID NO: 3776 - DNA, 19 bp, synthetic construct
  misc_feature 1..19: note = Synthetic
  source 1..19: mol_type = other DNA
atatcttatggccctgact

SEQ ID NO: 3777 - DNA, 20 bp, synthetic construct
  misc_feature 1..20: note = Synthetic
  source 1..20: mol_type = other DNA
tatatcttatggccctgact

SEQ ID NO: 3778 - DNA, 21 bp, synthetic construct
  misc_feature 1..21: note = Synthetic
  source 1..21: mol_type = other DNA
gtatatcttatggccctgact

SEQ ID NO: 3779 - DNA, 24 bp, synthetic construct
  misc_feature 1..24: note = Synthetic
  source 1..24: mol_type = other DNA
accgtatatcttatggccctgact

SEQ ID NO: 3780 - DNA, 25 bp, synthetic construct
  misc_feature 1..25: note = Synthetic
  source 1..25: mol_type = other DNA
aaccgtatatcttatggccctgact

SEQ ID NO: 3781 - DNA, 26 bp, synthetic construct
  misc_feature 1..26: note = Synthetic
  source 1..26: mol_type = other DNA
gaaccgtatatcttatggccctgact

SEQ ID NO: 3782 - DNA, 27 bp, synthetic construct
  misc_feature 1..27: note = Synthetic
  source 1..27: mol_type = other DNA
tgaaccgtatatcttatggccctgact

SEQ ID NO: 3783 - DNA, 26 bp, synthetic construct
  misc_feature 1..26: note = Synthetic
  source 1..26: mol_type = other DNA
tgaaccgtatatcttatggccctgac

SEQ ID NO: 3784 - DNA, 28 bp, synthetic construct
  misc_feature 1..28: note = Synthetic
  source 1..28: mol_type = other DNA
tgaaccgtatatcttatggccctgactg

SEQ ID NO: 3785 - DNA, 29 bp, synthetic construct
  misc_feature 1..29: note = Synthetic
  source 1..29: mol_type = other DNA
tgaaccgtatatcttatggccctgactgg

SEQ ID NO: 3786 - DNA, 30 bp, synthetic construct
  misc_feature 1..30: note = Synthetic
  source 1..30: mol_type = other DNA
tgaaccgtatatcttatggccctgactgga

SEQ ID NO: 3787 - DNA, 31 bp, synthetic construct; identical to SEQ ID NO: 3775
  misc_feature 1..31: note = Synthetic
  source 1..31: mol_type = other DNA

SEQ ID NO: 3788 - DNA, 32 bp, synthetic construct
  misc_feature 1..32: note = Synthetic
  source 1..32: mol_type = other DNA
tgaaccgtatatcttatggccctgactggaag

SEQ ID NO: 3789 - DNA, 33 bp, synthetic construct
  misc_feature 1..33: note = Synthetic
  source 1..33: mol_type = other DNA
tgaaccgtatatcttatggccctgactggaagg

SEQ ID NO: 3790 - DNA, 30 bp, synthetic construct
  misc_feature 1..30: note = Synthetic
  source 1..30: mol_type = other DNA
acctgaaccgtatatcttatggccctgact

SEQ ID NO: 3791 - DNA, 31 bp, synthetic construct
  misc_feature 1..31: note = Synthetic
  source 1..31: mol_type = other DNA
tacctgaaccgtatatcttatggccctgact

SEQ ID NO: 3792 - DNA, 32 bp, synthetic construct; identical to SEQ ID NO: 3533
  misc_feature 1..32: note = Synthetic
  source 1..32: mol_type = other DNA

SEQ ID NO: 3793 - DNA, 33 bp, synthetic construct
  misc_feature 1..33: note = Synthetic
  source 1..33: mol_type = other DNA
ggtacctgaaccgtatatcttatggccctgact

SEQ ID NO: 3794 - DNA, 34 bp, synthetic construct
  misc_feature 1..34: note = Synthetic
  source 1..34: mol_type = other DNA
tggtacctgaaccgtatatcttatggccctgact

SEQ ID NO: 3795 - DNA, 34 bp, synthetic construct
  misc_feature 1..34: note = Synthetic
  source 1..34: mol_type = other DNA
acctgaaccgtatatcctatggccctgactggaa

SEQ ID NO: 3796 - DNA, 28 bp, synthetic construct
  misc_feature 1..28: note = Synthetic
  source 1..28: mol_type = other DNA
accgtatatcctatggccctgactggaa

SEQ ID NO: 3797 - DNA, 36 bp, synthetic construct
  misc_feature 1..36: note = Synthetic
  source 1..36: mol_type = other DNA
acctgaaccgtatatcctatggccctgactggaagg

SEQ ID NO: 3798 - DNA, 35 bp, synthetic construct
  misc_feature 1..35: note = Synthetic
  source 1..35: mol_type = other DNA
acctgaaccgtatatcctatggccctgactggaag

SEQ ID NO: 3799 - DNA, 33 bp, synthetic construct
  misc_feature 1..33: note = Synthetic
  source 1..33: mol_type = other DNA
acctgaaccgtatatcctatggccctgactgga

SEQ ID NO: 3800 - DNA, 32 bp, synthetic construct
  misc_feature 1..32: note = Synthetic
  source 1..32: mol_type = other DNA
acctgaaccgtatatcctatggccctgactgg

SEQ ID NO: 3801 - DNA, 31 bp, synthetic construct; identical to SEQ ID NO: 3532
  misc_feature 1..31: note = Synthetic
  source 1..31: mol_type = other DNA

SEQ ID NO: 3802 - DNA, 29 bp, synthetic construct
  misc_feature 1..29: note = Synthetic
  source 1..29: mol_type = other DNA
aaccgtatatcctatggccctgactggaa

SEQ ID NO: 3803 - DNA, 31 bp, synthetic construct
  misc_feature 1..31: note = Synthetic
  source 1..31: mol_type = other DNA
tgaaccgtatatcctatggccctgactggaa

SEQ ID NO: 3804 - DNA, 35 bp, synthetic construct
  misc_feature 1..35: note = Synthetic
  source 1..35: mol_type = other DNA
tacctgaaccgtatatcctatggccctgactggaa

SEQ ID NO: 3805 - DNA, 38 bp, synthetic construct
  misc_feature 1..38: note = Synthetic
  source 1..38: mol_type = other DNA
tggtacctgaaccgtatatcctatggccctgactggaa

SEQ ID NO: 3806 - DNA, 36 bp, synthetic construct
  misc_feature 1..36: note = Synthetic
  source 1..36: mol_type = other DNA
gtacctgaaccgtatatcctatggccctgactggaa

SEQ ID NO: 3807 - DNA, 26 bp, synthetic construct
  misc_feature 1..26: note = Synthetic
  source 1..26: mol_type = other DNA
aaccgtatatcctatggccctgactg

SEQ ID NO: 3808 - DNA, 28 bp, synthetic construct
  misc_feature 1..28: note = Synthetic
  source 1..28: mol_type = other DNA
tgaaccgtatatcctatggccctgactg

SEQ ID NO: 3809 - DNA, 32 bp, synthetic construct
  misc_feature 1..32: note = Synthetic
  source 1..32: mol_type = other DNA
tacctgaaccgtatatcctatggccctgactg

SEQ ID NO: 3810 - DNA, 35 bp, synthetic construct
  misc_feature 1..35: note = Synthetic
  source 1..35: mol_type = other DNA
tggtacctgaaccgtatatcctatggccctgactg

SEQ ID NO: 3811 - DNA, 57 bp, synthetic construct
  misc_feature 1..57: note = Synthetic
  source 1..57: mol_type = other DNA
acactctttccctacacgacgctcttccgatctnnnnatgtgggctgcctagaaagg

SEQ ID NO: 3812 - DNA, 49 bp, synthetic construct
  misc_feature 1..49: note = Synthetic
  source 1..49: mol_type = other DNA
tggagttcagacgtgtgctcttccgatctcccagccaaacttgtcaacc

SEQ ID NO: 3813 - DNA, 57 bp, synthetic construct
  misc_feature 1..57: note = Synthetic
  source 1..57: mol_type = other DNA
acactctttccctacacgacgctcttccgatctnnnnacgtctcatatgccccttgg

SEQ ID NO: 3814 - DNA, 51 bp, synthetic construct
  misc_feature 1..51: note = Synthetic
  source 1..51: mol_type = other DNA
tggagttcagacgtgtgctcttccgatctacgtaggaattttggtgggaca

SEQ ID NO: 3815 - DNA, 57 bp, synthetic construct
  misc_feature 1..57: note = Synthetic
  source 1..57: mol_type = other DNA
acactctttccctacacgacgctcttccgatctnnnngaacccaggtagccagagac

SEQ ID NO: 3816 - DNA, 49 bp, synthetic construct
  misc_feature 1..49: note = Synthetic
  source 1..49: mol_type = other DNA
tggagttcagacgtgtgctcttccgatcttcctttcaacccgaacggag

SEQ ID NO: 3817 - DNA, 57 bp, synthetic construct
  misc_feature 1..57: note = Synthetic
  source 1..57: mol_type = other DNA
acactctttccctacacgacgctcttccgatctnnnncagctcagcctgagtgttga

SEQ ID NO: 3818 - DNA, 48 bp, synthetic construct
  misc_feature 1..48: note = Synthetic
  source 1..48: mol_type = other DNA
tggagttcagacgtgtgctcttccgatctctcgtgggtttgtggttgc

SEQ ID NO: 3819 - DNA, 57 bp, synthetic construct
  misc_feature 1..57: note = Synthetic
  source 1..57: mol_type = other DNA
acactctttccctacacgacgctcttccgatctnnnncattgcagagaggcgtatca

SEQ ID NO: 3820 - DNA, 47 bp, synthetic construct
  misc_feature 1..47: note = Synthetic
  source 1..47: mol_type = other DNA
tggagttcagacgtgtgctcttccgatctggggtcccaggtgctgac

SEQ ID NO: 3821 - DNA, 58 bp, synthetic construct
  misc_feature 1..58: note = Synthetic
  source 1..58: mol_type = other DNA
acactctttccctacacgacgctcttccgatctnnnnagggttggccaatctactccc

SEQ ID NO: 3822 - DNA, 51 bp, synthetic construct
  misc_feature 1..51: note = Synthetic
  source 1..51: mol_type = other DNA
tggagttcagacgtgtgctcttccgatctgtcttctctgtctccacatgcc

SEQ ID NO: 3823 - DNA, 57 bp, synthetic construct
  misc_feature 1..57: note = Synthetic
  source 1..57: mol_type = other DNA
acactctttccctacacgacgctcttccgatctnnnngtcagtggaacaagccgagt

SEQ ID NO: 3824 - DNA, 49 bp, synthetic construct
  misc_feature 1..49: note = Synthetic
  source 1..49: mol_type = other DNA
tggagttcagacgtgtgctcttccgatctacttggttggggtaacggtg

SEQ ID NO: 3825 - DNA, 57 bp, synthetic construct
  misc_feature 1..57: note = Synthetic
  source 1..57: mol_type = other DNA
acactctttccctacacgacgctcttccgatctnnnncatacaggtgtggcgagagg

SEQ ID NO: 3826 - DNA, 49 bp, synthetic construct
  misc_feature 1..49: note = Synthetic
  source 1..49: mol_type = other DNA
tggagttcagacgtgtgctcttccgatctccagcctcctttggttagca

SEQ ID NO: 3827 - DNA, 59 bp, synthetic construct
  misc_feature 1..59: note = Synthetic
  source 1..59: mol_type = other DNA
acactctttccctacacgacgctcttccgatctnnnntcacaaacaagacagggaactg

SEQ ID NO: 3828 - DNA, 50 bp, synthetic construct
  misc_feature 1..50: note = Synthetic
  source 1..50: mol_type = other DNA
tggagttcagacgtgtgctcttccgatctagatgtagggctagaggggtg

SEQ ID NO: 3829 - DNA, 59 bp, synthetic construct
  misc_feature 1..59: note = Synthetic
  source 1..59: mol_type = other DNA
acactctttccctacacgacgctcttccgatctnnnnacttggtgccaaattcttctcc

SEQ ID NO: 3830 - DNA, 50 bp, synthetic construct
  misc_feature 1..50: note = Synthetic
  source 1..50: mol_type = other DNA
tggagttcagacgtgtgctcttccgatctaaagagggaatgggctttgga

SEQ ID NO: 3831 - DNA, 58 bp, synthetic construct
  misc_feature 1..58: note = Synthetic
  source 1..58: mol_type = other DNA
acactctttccctacacgacgctcttccgatctnnnncacaacagcttcatgtcagcc

SEQ ID NO: 3832 - DNA, 52 bp, synthetic construct
  misc_feature 1..52: note = Synthetic
  source 1..52: mol_type = other DNA
tggagttcagacgtgtgctcttccgatctacgttaatgtttcctgatggtcc

SEQ ID NO: 3833 - DNA, 57 bp, synthetic construct
  misc_feature 1..57: note = Synthetic
  source 1..57: mol_type = other DNA
acactctttccctacacgacgctcttccgatctnnnntcccctgttgacctggagaa

SEQ ID NO: 3834 - DNA, 49 bp, synthetic construct
  misc_feature 1..49: note = Synthetic
  source 1..49: mol_type = other DNA
tggagttcagacgtgtgctcttccgatctcactgtacttgccctgacca

SEQ ID NO: 3835 - DNA, 57 bp, synthetic construct
  misc_feature 1..57: note = Synthetic
  source 1..57: mol_type = other DNA
acactctttccctacacgacgctcttccgatctnnnnttggtgttgacagggagcaa

SEQ ID NO: 3836 - DNA, 49 bp, synthetic construct
  misc_feature 1..49: note = Synthetic
  source 1..49: mol_type = other DNA
tggagttcagacgtgtgctcttccgatctctgagatgtgggcagaaggg

SEQ ID NO: 3837 - DNA, 57 bp, synthetic construct
  misc_feature 1..57: note = Synthetic
  source 1..57: mol_type = other DNA
acactctttccctacacgacgctcttccgatctnnnntgagagggaacagaagggct

SEQ ID NO: 3838 - DNA, 49 bp, synthetic construct
  misc_feature 1..49: note = Synthetic
  source 1..49: mol_type = other DNA
tggagttcagacgtgtgctcttccgatctgtccaaaggcccaagaacct

SEQ ID NO: 3839 - DNA, 58 bp, synthetic construct
  misc_feature 1..58: note = Synthetic
  source 1..58: mol_type = other DNA
acactctttccctacacgacgctcttccgatctnnnntcctagcactttggaaggtcg

SEQ ID NO: 3840 - DNA, 51 bp, synthetic construct
  misc_feature 1..51: note = Synthetic
  source 1..51: mol_type = other DNA
tggagttcagacgtgtgctcttccgatctgctcatcttaatctgctcagcc

SEQ ID NO: 3841 - DNA, 57 bp, synthetic construct
  misc_feature 1..57: note = Synthetic
  source 1..57: mol_type = other DNA
acactctttccctacacgacgctcttccgatctnnnnggcatggcttctgagactca

SEQ ID NO: 3842 - DNA, 53 bp, synthetic construct
  misc_feature 1..53: note = Synthetic
  source 1..53: mol_type = other DNA
tggagttcagacgtgtgctcttccgatctgtctcccttgcactccctgtcttt

SEQ ID NO: 3843 - DNA, 57 bp, synthetic construct
  misc_feature 1..57: note = Synthetic
  source 1..57: mol_type = other DNA
acactctttccctacacgacgctcttccgatctnnnntttggcaatggaggcattgg

SEQ ID NO: 3844 - DNA, 49 bp, synthetic construct
  misc_feature 1..49: note = Synthetic
  source 1..49: mol_type = other DNA
tggagttcagacgtgtgctcttccgatctgaagaggctgcccatgagag

SEQ ID NO: 3845 - DNA, 57 bp, synthetic construct
  misc_feature 1..57: note = Synthetic
  source 1..57: mol_type = other DNA
acactctttccctacacgacgctcttccgatctnnnnggtctgaggctcgaatcctg

SEQ ID NO: 3846 - DNA, 49 bp, synthetic construct
  misc_feature 1..49: note = Synthetic
  source 1..49: mol_type = other DNA
tggagttcagacgtgtgctcttccgatctctgtggcctccatatccctg

SEQ ID NO: 3847 - DNA, 57 bp, synthetic construct
  misc_feature 1..57: note = Synthetic
  source 1..57: mol_type = other DNA
acactctttccctacacgacgctcttccgatctnnnntttccaccagaactcagccc

SEQ ID NO: 3848 - DNA, 49 bp, synthetic construct
  misc_feature 1..49: note = Synthetic
  source 1..49: mol_type = other DNA
tggagttcagacgtgtgctcttccgatctcctcggttcctccacaacac

SEQ ID NO: 3849 - DNA, 62 bp, synthetic construct
  misc_feature 1..62: note = Synthetic
  source 1..62: mol_type = other DNA
acactctttccctacacgacgctcttccgatctnnnngtggggagatttgcatctgtggagg

SEQ ID NO: 3850 - DNA, 55 bp, synthetic construct
  misc_feature 1..55: note = Synthetic
  source 1..55: mol_type = other DNA
tggagttcagacgtgtgctcttccgatctgcttttataccatcttggggttacag

SEQ ID NO: 3851 - DNA, 61 bp, synthetic construct
  misc_feature 1..61: note = Synthetic
  source 1..61: mol_type = other DNA
acactctttccctacacgacgctcttccgatctnnnncaatgtgcttcaacccatcacggc

SEQ ID NO: 3852 - DNA, 56 bp, synthetic construct
  misc_feature 1..56: note = Synthetic
  source 1..56: mol_type = other DNA
tggagttcagacgtgtgctcttccgatctccatgaatttgtgatggatgcagtctg

SEQ ID NO: 3853 - DNA, 61 bp, synthetic construct
  misc_feature 1..61: note = Synthetic
  source 1..61: mol_type = other DNA
acactctttccctacacgacgctcttccgatctnnnngagaaggaggtgcaggagctagac

SEQ ID NO: 3854 - DNA, 53 bp, synthetic construct
  misc_feature 1..53: note = Synthetic
  source 1..53: mol_type = other DNA
tggagttcagacgtgtgctcttccgatctcatcccgaccttcatccctcctgg

SEQ ID NO: 3855 - DNA, 62 bp, synthetic construct
  misc_feature 1..62: note = Synthetic
  source 1..62: mol_type = other DNA
acactctttccctacacgacgctcttccgatctnnnngtagttctgacattcctcctgaggg

SEQ ID NO: 3856 - DNA, 52 bp, synthetic construct
  misc_feature 1..52: note = Synthetic
  source 1..52: mol_type = other DNA
tggagttcagacgtgtgctcttccgatcttcaaacaaggtgcagatacagca

SEQ ID NO: 3857 - DNA, 59 bp, synthetic construct
  misc_feature 1..59: note = Synthetic
  source 1..59: mol_type = other DNA
acactctttccctacacgacgctcttccgatctnnnngcgggcagtggcgtcttagtcg

SEQ ID NO: 3858 - DNA, 51 bp, synthetic construct
  misc_feature 1..51: note = Synthetic
  source 1..51: mol_type = other DNA
tggagttcagacgtgtgctcttccgatctccctgggtttggttggctgctc

SEQ ID NO: 3859 - DNA, 58 bp, synthetic construct
  misc_feature 1..58: note = Synthetic
  source 1..58: mol_type = other DNA
acactctttccctacacgacgctcttccgatctnnnnctccttgccgcccagccggtc

SEQ ID NO: 3860 - DNA, 52 bp, synthetic construct
  misc_feature 1..52: note = Synthetic
  source 1..52: mol_type = other DNA
tggagttcagacgtgtgctcttccgatctcactggggaagaggcgaggacac

SEQ ID NO: 3861 - DNA, 60 bp, synthetic construct
  misc_feature 1..60: note = Synthetic
  source 1..60: mol_type = other DNA
acactctttccctacacgacgctcttccgatctnnnnccagtgtttcccatccccaacac

SEQ ID NO: 3862 - DNA, 52 bp, synthetic construct
  misc_feature 1..52: note = Synthetic
  source 1..52: mol_type = other DNA
tggagttcagacgtgtgctcttccgatctgaatggatccccccctagagctc

SEQ ID NO: 3863 - DNA, 59 bp, synthetic construct
  misc_feature 1..59: note = Synthetic
  source 1..59: mol_type = other DNA
acactctttccctacacgacgctcttccgatctnnnncaggcccacaggtccttctgga

SEQ ID NO: 3864 - protein, 18 aa, synthetic construct
  REGION 1..18: note = Synthetic
KRTADGSEFESPKKKRKV

SEQ ID NO: 3865 - protein, 236 aa, Homo sapiens
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 3866 - protein, 236 aa, Mus musculus
MSEPPRAETFVFLDLEATGLPNMDPEIAEISLFAVHRSSLENPERDDSGSLVLPRVLDKLTLCMCPERPFTAKASEITGLSSESLMHCGKAGFNGAVVRTLQGFLSRQEGPICLVAHNGFDYDFPLLCTELQRLGAHLPQDTVCLDTLPALRGLDRAHSHGTRAQGRKSYSLASLFHRYFQAEPSAAHSAEGDVHTLLLIFLHRAPELLAWADEQARSWAHIEPMYVPPDGPSLEA

SEQ ID NO: 3867 - protein, 236 aa, Rattus norvegicus
MSEPLRAETFVFLDLEATGLPNMDPEIAEISLFAVHRSSLENPERDDSGSLVLPRVLDKLTLCMCPERPFTAKASEITGLSSEGLMNCRKAAFNDAVVRTLQGFLSRQEGPICLVAHNGFDYDFPLLCTELQRLGAHLPRDTVCLDTLPALRGLDRVHSHGTRAQGRKSYSLASLFHRYFQAEPSAAHSAEGDVNTLLLIFLHRAPELLAWADEQARSWAHIEPMYVPPDGPSLEA

SEQ ID NO: 3868 - protein, 803 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 3869 - protein, 846 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 3870 - protein, 845 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 3871 - protein, 580 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 3872 - protein, 410 aa, Homo sapiens
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 3873 - protein, 84 aa, synthetic construct
  REGION 1..84: note = Synthetic
MTNLSDIIEKETGKQLVIQESILMLPEEVEEVIGNKPESDILVHTAYDESTDENVMLLTSDAPEYKPWALVIQDSNGENKIKML

SEQ ID NO: 3874 - skipped

SEQ ID NO: 3875 - protein, 1165 aa, synthetic construct
  REGION 1..1165: note = Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNSGGSKRTADGSEFEPKKKRKV

SEQ ID NO: 3876 - protein, 1128 aa, synthetic construct
  REGION 1..1128: note = Synthetic
MKRTADGSEFESPKKKRKVIKIATRKYLGKQNVYDIGVERDHNFALKNGFIASNCFNEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRK

SEQ ID NO: 3877 - protein, 1024 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAK

SEQ ID NO: 3878 - protein, 1023 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAK

SEQ ID NO: 3879 - protein, 344 aa, Streptococcus pyogenes
SEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3880-3888 - skipped (9 entries)

SEQ ID NO: 3889 - protein, 12 aa, synthetic construct
  REGION 1..12: note = Synthetic
SGGSSGGSSGGS

SEQ ID NO: 3890-3933 - skipped (44 entries)

SEQ ID NO: 3934 - protein, 11 aa, synthetic construct
  REGION 1..11: note = Synthetic
RQRRNELKRSF

SEQ ID NO: 3935 - protein, 38 aa, synthetic construct
  REGION 1..38: note = Synthetic
NQSSNFGPMKGGNFGGRSSGPYGGGGQYFAKPRNQGGY

SEQ ID NO: 3936 - protein, 16 aa, Rattus norvegicus
KRXXXXXXXXXXKKKL

SEQ ID NO: 3937 - protein, 345 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVLFSADLRQSRHAQEPPAKRRKGSKGPEG

SEQ ID NO: 3938 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 3939 - DNA, 10 bp, synthetic construct
  misc_feature 1..10: note = Synthetic
  misc_feature 5..6: note = May be non-consecutive
  source 1..10: mol_type = other DNA
gttttaaaac

SEQ ID NO: 3940 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHNCVNITIKQHTVTTTTKGENFTETDVKMMERVVEQMCITQYERESQAYYQRGSSMVLFSSPPV

SEQ ID NO: 3941 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHKVTTTTKGENFTETDVKMMERVVEQMCITQYERESQAYYQRGSSMVLFSSPPV

SEQ ID NO: 3942 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGKNFTETDVKMMERVVEQMCITQYERESQAYYQRGSSMVLFSSPPV

SEQ ID NO: 3943 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTKTDVKMMERVVEQMCITQYERESQAYYQRGSSMVLFSSPPV

SEQ ID NO: 3944 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDIKMMERVVEQMCITQYERESQAYYQRGSSMVLFSSPPV

SEQ ID NO: 3945 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMEHVVEQMCITQYERESQAYYQRGSSMVLFSSPPV

SEQ ID NO: 3946 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVIEQMCITQYERESQAYYQRGSSMVLFSSPPV

SEQ ID NO: 3947 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVQQMCITQYERESQAYYQRGSSMVLFSSPPV

SEQ ID NO: 3948 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSRVLFSSPPV

SEQ ID NO: 3949 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKLSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3950 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKLKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3951 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAVAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3952 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLVSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3953 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFGHDCVNITIKQHTVTTTTKGENFTETDVKMMERVVEQMCITQYERESQAYYQRGSSMVLFSSPPV

SEQ ID NO: 3954 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQRTVTTTTKGENFTETDVKMMERVVEQMCITQYERESQAYYQRGSSMVLFSSPPV

SEQ ID NO: 3955 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENSTETDVKMMERVVEQMCITQYERESQAYYQRGSSMVLFSSPPV

SEQ ID NO: 3956 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETNVKMMERVVEQMCITQYERESQAYYQRGSSMVLFSSPPV

SEQ ID NO: 3957 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEPMCITQYERESQAYYQRGSSMVLFSSPPV

SEQ ID NO: 3958 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITRYERESQAYYQRGSSMVLFSSPPV

SEQ ID NO: 3959 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSTVLFSSPPV

SEQ ID NO: 3960 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGSYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3961 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGVYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3962 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 3963 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMGEYSNQNNFVHDCVNITIKQHTVTTTTKGENFTETDVKMMERVVEQMCITQYERESQAYYQRGSSMVLFSSPPV

SEQ ID NO: 3964 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMNEYSNQNNFVHDCVNITIKQHTVTTTTKGENFTETDVKMMERVVEQMCITQYERESQAYYQRGSSMVLFSSPPV

SEQ ID NO: 3965 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSSQNNFVHDCVNITIKQHTVTTTTKGENFTETDVKMMERVVEQMCITQYERESQAYYQRGSSMVLFSSPPV

SEQ ID NO: 3966 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYKRESQAYYQRGSSMVLFSSPPV

SEQ ID NO: 3967 - protein, 240 aa, synthetic construct
  REGION 1..240: note = Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSSPV

SEQ ID NO: 3968 - protein, 5 aa, synthetic construct
  REGION 1..5: note = Synthetic
EAAAK

SEQ ID NO: 3969 - protein, 10 aa, synthetic construct
  REGION 1..10: note = Synthetic
EAAAKEAAAK

SEQ ID NO: 3970 - protein, 15 aa, synthetic construct
  REGION 1..15: note = Synthetic
EAAAKEAAAKEAAAK

SEQ ID NO: 3971 - DNA, 20 bp, synthetic construct
  misc_feature 1..20: note = Synthetic
  source 1..20: mol_type = other DNA
gattggctttgatttcccta

SEQ ID NO: 3972 - DNA, 20 bp, synthetic construct
  misc_feature 1..20: note = Synthetic
  source 1..20: mol_type = other DNA
gtatatgattgttactgaga

SEQ ID NO: 3973 - DNA, 20 bp, synthetic construct
  misc_feature 1..20: note = Synthetic
  source 1..20: mol_type = other DNA
gcagttgcctaagaactggt

SEQ ID NO: 3974 - DNA, 20 bp, synthetic construct
  misc_feature 1..20: note = Synthetic
  source 1..20: mol_type = other DNA
gaggagagtaaagtgattgg

SEQ ID NO: 3975 - DNA, 20 bp, synthetic construct
  misc_feature 1..20: note = Synthetic
  source 1..20: mol_type = other DNA
gcagagccaggaacccctgt

SEQ ID NO: 3976 - DNA, 20 bp, synthetic construct
  misc_feature 1..20: note = Synthetic
  source 1..20: mol_type = other DNA
gggaaggggcaggagagcca

SEQ ID NO: 3977 - DNA, 20 bp, synthetic construct
  misc_feature 1..20: note = Synthetic
  source 1..20: mol_type = other DNA
gaatatgtcccagatagcac

SEQ ID NO: 3978 - DNA, 20 bp, synthetic construct
  misc_feature 1..20: note = Synthetic
  source 1..20: mol_type = other DNA
ggggactctttaaggaaaga

SEQ ID NO: 3979 - DNA, 20 bp, synthetic construct
  misc_feature 1..20: note = Synthetic
  source 1..20: mol_type = other DNA
gagaaagagaaagggagtag

SEQ ID NO: 3980 - DNA, 20 bp, synthetic construct
  misc_feature 1..20: note = Synthetic
  source 1..20: mol_type = other DNA
gagtagaggcggccacgacc

SEQ ID NO: 3981 - DNA, 20 bp, synthetic construct
  misc_feature 1..20: note = Synthetic
  source 1..20: mol_type = other DNA
gatcagtgaaacgcaccaga

SEQ ID NO: 3982 - DNA, 20 bp, synthetic construct
  misc_feature 1..20: note = Synthetic
  source 1..20: mol_type = other DNA
gcagctcaggttctgggaga

SEQ ID NO: 3983 - DNA, 20 bp, synthetic construct
  misc_feature 1..20: note = Synthetic
  source 1..20: mol_type = other DNA
gtggccactgagaaccgggc

SEQ ID NO: 3984 - DNA, 20 bp, synthetic construct
  misc_feature 1..20: note = Synthetic
  source 1..20: mol_type = other DNA
gaatctgcctaacaggaggt

SEQ ID NO: 3985 - DNA, 20 bp, synthetic construct
  misc_feature 1..20: note = Synthetic
  source 1..20: mol_type = other DNA
gtcaccaatcctgtccctag

SEQ ID NO: 3986 - DNA, 20 bp, synthetic construct
  misc_feature 1..20: note = Synthetic
  source 1..20: mol_type = other DNA
gctggccccccaccgcccca

SEQ ID NO: 3987 - DNA, 20 bp, synthetic construct
  misc_feature 1..20: note = Synthetic
  source 1..20: mol_type = other DNA
gacgtcacggcgctgcccca

SEQ ID NO: 3988 - DNA, 20 bp, synthetic construct
  misc_feature 1..20: note = Synthetic
  source 1..20: mol_type = other DNA
ggtgtgctgggcaggtcgcg

SEQ ID NO: 3989 - DNA, 20 bp, synthetic construct
  misc_feature 1..20: note = Synthetic
  source 1..20: mol_type = other DNA
gtccttggcaagcccaggag

SEQ ID NO: 3990 - DNA, 20 bp, synthetic construct
  misc_feature 1..20: note = Synthetic
  source 1..20: mol_type = other DNA
gtgcgtcctaggtgttcacc

SEQ ID NO: 3991 - DNA, 20 bp, synthetic construct
  misc_feature 1..20: note = Synthetic
  source 1..20: mol_type = other DNA
gtcctggcagggctgtggtg

SEQ ID NO: 3992 - DNA, 20 bp, synthetic construct
  misc_feature 1..20: note = Synthetic
  source 1..20: mol_type = other DNA
gtgacctgcccggttctcag

SEQ ID NO: 3993 - DNA, 20 bp, synthetic construct
  misc_feature 1..20: note = Synthetic
  source 1..20: mol_type = other DNA
gagcttggcagggggtggga

SEQ ID NO: 3994 - DNA, 20 bp, synthetic construct
  misc_feature 1..20: note = Synthetic
  source 1..20: mol_type = other DNA
gagccagagaggatcctggg

SEQ ID NO: 3995 - DNA, 20 bp, synthetic construct
  misc_feature 1..20: note = Synthetic
  source 1..20: mol_type = other DNA
gatggagccagagaggatcc

SEQ ID NO: 3996 - DNA, 20 bp, synthetic construct
  misc_feature 1..20: note = Synthetic
  source 1..20: mol_type = other DNA
ggggccactagggacaggat

SEQ ID NO: 3997 - DNA, 20 bp, synthetic construct
  misc_feature 1..20: note = Synthetic
  source 1..20: mol_type = other DNA
gtcccctccaccccacagtg

SEQ ID NO: 3998 - DNA, 20 bp, synthetic construct
  misc_feature 1..20: note = Synthetic
  source 1..20: mol_type = other DNA
gggaccaccttatattccca

SEQ ID NO: 3999 - DNA, 20 bp, synthetic construct
  misc_feature 1..20: note = Synthetic
  source 1..20: mol_type = other DNA
gacctgcccagcacaccctg

SEQ ID NO: 4000 - DNA, 20 bp, synthetic construct
  misc_feature 1..20: note = Synthetic
  source 1..20: mol_type = other DNA
gcgactcctggaagtggcca

SEQ ID NO: 4001 - DNA, 20 bp, synthetic construct
  misc_feature 1..20: note = Synthetic
  source 1..20: mol_type = other DNA
ggacttcccagtgtgcatcg

SEQ ID NO: 4002 - DNA, 20 bp, synthetic construct
  misc_feature 1..20: note = Synthetic
  source 1..20: mol_type = other DNA
tttgcagtttatcaggatga

SEQ ID NO: 4003 - DNA, 20 bp, synthetic construct
  misc_feature 1..20: note = Synthetic
  source 1..20: mol_type = other DNA
ggttgagcaggtagatgtca

SEQ ID NO: 4004 - DNA, 20 bp, synthetic construct
  misc_feature 1..20: note = Synthetic
  source 1..20: mol_type = other DNA
ctgggcggcagcatagtgag

SEQ ID NO: 4005 - DNA, 20 bp, synthetic construct
  misc_feature 1..20: note = Synthetic
  source 1..20: mol_type = other DNA
gtcaagagttgacacattgt

SEQ ID NO: 4006 - DNA, 20 bp, synthetic construct
  misc_feature 1..20: note = Synthetic
  source 1..20: mol_type = other DNA
cccaagtgatcacacttgtc

SEQ ID NO: 4007 - DNA, 20 bp, synthetic construct
  misc_feature 1..20: note = Synthetic
  source 1..20: mol_type = other DNA
ccacccaagtgatcacactt

SEQ ID NO: 4008 - DNA, 20 bp, synthetic construct
  misc_feature 1..20: note = Synthetic
  source 1..20: mol_type = other DNA
gggagagacgcaaacacagc

SEQ ID NO: 4009 - DNA, 20 bp, synthetic construct
  misc_feature 1..20: note = Synthetic
  source 1..20: mol_type = other DNA
tctctgacctgtttttcctt

SEQ ID NO: 4010 - DNA, 20 bp, synthetic construct
  misc_feature 1..20: note = Synthetic
  source 1..20: mol_type = other DNA
tcttactgtccccttctggg

SEQ ID NO: 4011 - DNA, 20 bp, synthetic construct
  misc_feature 1..20: note = Synthetic
  source 1..20: mol_type = other DNA
tctgggctcactatgctgcc

SEQ ID NO: 4012 - DNA, 20 bp, synthetic construct
  misc_feature 1..20: note = Synthetic
  source 1..20: mol_type = other DNA
cccagtgggactttggaaat

SEQ ID NO: 4013 - DNA, 20 bp, synthetic construct
  misc_feature 1..20: note = Synthetic
  source 1..20: mol_type = other DNA
gtgggactttggaaatacaa

SEQ ID NO: 4014 - DNA, 20 bp, synthetic construct
  misc_feature 1..20: note = Synthetic
  source 1..20: mol_type = other DNA
cctgacaatcgataggtacc

SEQ ID NO: 4015 - DNA, 20 bp, synthetic construct
  misc_feature 1..20: note = Synthetic
  source 1..20: mol_type = other DNA
ggaatcatctttaccagatc

SEQ ID NO: 4016 - DNA, 20 bp, synthetic construct
  misc_feature 1..20: note = Synthetic
  source 1..20: mol_type = other DNA
gcagctctcattttccatac

SEQ ID NO: 4017 - DNA, 20 bp, synthetic construct
  misc_feature 1..20: note = Synthetic
  source 1..20: mol_type = other DNA
tacagtcagtatcaattctg

SEQ ID NO: 4018 - DNA, 20 bp, synthetic construct
  misc_feature 1..20: note = Synthetic
  source 1..20: mol_type = other DNA
gactgaaacttcacagaata

SEQ ID NO: 4019 - DNA, 21 bp, synthetic construct
  misc_feature 1..21: note = Synthetic
  source 1..21: mol_type = other DNA
gatttatgagatcaacagcac

SEQ ID NO: 4020 - DNA, 21 bp, synthetic construct
  misc_feature 1..21: note = Synthetic
  source 1..21: mol_type = other DNA
gacaccaaaaactgccacagg

SEQ ID NO: 4021 - DNA, 21 bp, synthetic construct
  misc_feature 1..21: note = Synthetic
  source 1..21: mol_type = other DNA
gcactcatttcctccaagctc

SEQ ID NO: 4022 - DNA, 20 bp, synthetic construct
  misc_feature 1..20: note = Synthetic
  source 1..20: mol_type = other DNA
gtaggtacaggacagggcag

SEQ ID NO: 4023 - DNA, 21 bp, synthetic construct
  misc_feature 1..21: note = Synthetic
  source 1..21: mol_type = other DNA
gagataggtaggtacaggaca

SEQ ID NO: 4024 - DNA, 20 bp, synthetic construct
  misc_feature 1..20: note = Synthetic
  source 1..20: mol_type = other DNA
gtgaaaagataggtaggtac

SEQ ID NO: 4025 - DNA, 20 bp, synthetic construct
  misc_feature 1..20: note = Synthetic
  source 1..20: mol_type = other DNA
gttatggtttactccatcta

SEQ ID NO: 4026 - DNA, 20 bp, synthetic construct
  misc_feature 1..20: note = Synthetic
  source 1..20: mol_type = other DNA
gttttggtttaccctatcta

SEQ ID NO: 4027 - DNA, 21 bp, synthetic construct
  misc_feature 1..21: note = Synthetic
  source 1..21: mol_type = other DNA
gctgtggaactgcaacacact

SEQ ID NO: 4028 - DNA, 21 bp, synthetic construct
  misc_feature 1..21: note = Synthetic
  source 1..21: mol_type = other DNA
gtgccacctaacagtgagctg

SEQ ID NO: 4029 - DNA, 51 bp, synthetic construct
  misc_feature 1..51: note = Synthetic
  source 1..51: mol_type = other DNA
atgatcctgacgacggagaccgccgtcgtcgacaagcccgtgctcagtctg

SEQ ID NO: 4030 - DNA, 47 bp, synthetic construct
  misc_feature 1..47: note = Synthetic
  source 1..47: mol_type = other DNA
tcctgacgacggagaccgccgtcgtcgacaagcccgtgctcagtctg

SEQ ID NO: 4031 - DNA, 43 bp, synthetic construct
  misc_feature 1..43: note = Synthetic
  source 1..43: mol_type = other DNA
gacgacggagaccgccgtcgtcgacaagcccgtgctcagtctg

SEQ ID NO: 4032 - DNA, 50 bp, synthetic construct
  misc_feature 1..50: note = Synthetic
  source 1..50: mol_type = other DNA
ggcttgtcgacgacggcggtctccgtcgtcaggatcatccgggatactgg

SEQ ID NO: 4033 - DNA, 46 bp, synthetic construct
  misc_feature 1..46: note = Synthetic
  source 1..46: mol_type = other DNA
tgtcgacgacggcggtctccgtcgtcaggatcatccgggatactgg

SEQ ID NO: 4034 - DNA, 42 bp, synthetic construct
  misc_feature 1..42: note = Synthetic
  source 1..42: mol_type = other DNA
gacgacggcggtctccgtcgtcaggatcatccgggatactgg

SEQ ID NO: 4035 - DNA, 56 bp, synthetic construct
  misc_feature 1..56: note = Synthetic
  source 1..56: mol_type = other DNA
taccgtacaccactgagaccgcggtggttgaccagacaaacctcgtgctcagtctg

SEQ ID NO: 4036 - DNA, 52 bp, synthetic construct
  misc_feature 1..52: note = Synthetic
  source 1..52: mol_type = other DNA
gtacaccactgagaccgcggtggttgaccagacaaacctcgtgctcagtctg

SEQ ID NO: 4037 - DNA, 48 bp, synthetic construct
  misc_feature 1..48: note = Synthetic
  source 1..48: mol_type = other DNA
accactgagaccgcggtggttgaccagacaaacctcgtgctcagtctg

SEQ ID NO: 4038 - DNA, 56 bp, synthetic construct
  misc_feature 1..56: note = Synthetic
  source 1..56: mol_type = other DNA
gtctggtcaaccaccgcggtctcagtggtgtacggtacaaacctccgggatactgg

SEQ ID NO: 4039 - DNA, 52 bp, synthetic construct
  misc_feature 1..52: note = Synthetic
  source 1..52: mol_type = other DNA
ggtcaaccaccgcggtctcagtggtgtacggtacaaacctccgggatactgg

SEQ ID NO: 4040 - DNA, 48 bp, synthetic construct
  misc_feature 1..48: note = Synthetic
  source 1..48: mol_type = other DNA
aaccaccgcggtctcagtggtgtacggtacaaacctccgggatactgg

SEQ ID NO: 4041 - DNA, 59 bp, synthetic construct
  misc_feature 1..59: note = Synthetic
  source 1..59: mol_type = other DNA
tggaggaagcagggcttcctttcctctgccatcacacctgcactcccgtgctcagtctg

SEQ ID NO: 4042 - DNA, 83 bp, synthetic construct
  misc_feature 1..83: note = Synthetic
  source 1..83: mol_type = other DNA
tggaggaagcagggcttcctttcctctgccatcacccgtctcctggggagatggtttccacctgcactcccgtgctcagtctg

SEQ ID NO: 4043 - DNA, 155 bp, synthetic construct
  misc_feature 1..155: note = Synthetic
  source 1..155: mol_type = other DNA
tggaggaagcagggcttcctttcctctgccatcaaaatttctttccatcttcaagcatcccggtgtagtgcaccacgcaggtctggccgcgcttggggaaggtgcgcccgtctcctggggagatggtttccacctgcactcccgtgctcagtctg

SEQ ID NO: 4044 - DNA, 368 bp, synthetic construct
  misc_feature 1..368: note = Synthetic
  source 1..368: mol_type = other DNA
tggaggaagcagggcttcctttcctctgccatcattccagttttagaagctccacatcgaagacgagagtggcatgtggtgggatgatgcctgggtgcccagtggcaccataggcataatctggagatatagtcagtttggctctctgacccacactcatctgggcaaccccttcttcccagcctcggatcacctcctgcttgcctagcataaacttaaagggcttgtttctgtcccgggaggaatcaaatttctttccatcttcaagcatcccggtgtagtgcaccacgcaggtctggccgcgcttggggaaggtgcgcccgtctcctggggagatggtttccacctgcactcccgtgctcagtctg

SEQ ID NO: 4045 - DNA, 84 bp, synthetic construct
  misc_feature 1..84: note = Synthetic
  source 1..84: mol_type = other DNA
accacgcaggtctggccgcgcttggggaaggtgcgcccgtctcctggggagatggtttccacctgcactcccgtgctcagtctg

SEQ ID NO: 4046 - DNA, 81 bp, synthetic construct
  misc_feature 1..81: note = Synthetic
  source 1..81: mol_type = other DNA
accttccccaagcgcggccagacctgcgtggtgcactacaccgggatgcttgaagatggaaagaaatttccgggatactgg

SEQ ID NO: 4047 - DNA, 26 bp, synthetic construct
  misc_feature 1..26: note = Synthetic
  source 1..26: mol_type = other DNA
tcctctgccatcacgtgctcagtctg

SEQ ID NO: 4048 - DNA, 25 bp, synthetic construct
  misc_feature 1..25: note = Synthetic
  source 1..25: mol_type = other DNA
tgatggcagaggaccgggatactgg

SEQ ID NO: 4049 - DNA, 47 bp, synthetic construct
  misc_feature 1..47: note = Synthetic
  source 1..47: mol_type = other DNA
tggaggaagcagggcttcctttcctctgccatcacgtgctcagtctg

SEQ ID NO: 4050 - DNA, 46 bp, synthetic construct
  misc_feature 1..46: note = Synthetic
  source 1..46: mol_type = other DNA
tgatggcagaggaaaggaagccctgcttcctccaccgggatactgg

SEQ ID NO: 4051 - DNA, 39 bp, synthetic construct
  misc_feature 1..39: note = Synthetic
  source 1..39: mol_type = other DNA
tgcaggagctgcatcctctgccatcacgtgctcagtctg

SEQ ID NO: 4052 - DNA, 38 bp, synthetic construct
  misc_feature 1..38: note = Synthetic
  source 1..38: mol_type = other DNA
tgatggcagaggatgcagctcctgcaccgggatactgg

SEQ ID NO: 4053 - DNA, 44 bp, synthetic construct
  misc_feature 1..44: note = Synthetic
  source 1..44: mol_type = other DNA
gcccagccaaacttgtcaaccagtatcccggcgtgctcagtctg

SEQ ID NO: 4054 - DNA, 43 bp, synthetic construct
  misc_feature 1..43: note = Synthetic
  source 1..43: mol_type = other DNA
gggtcaatccttggggcccagactgagcacgccgggatactgg

SEQ ID NO: 4055 - DNA, 71 bp, synthetic construct
  misc_feature 1..71: note = Synthetic
  source 1..71: mol_type = other DNA
tcctctgccatcacgtgctcagtctgttaaataacgcggttctatctagttacgcgttaaaccaactagaa

SEQ ID NO: 4056 - DNA, 70 bp, synthetic construct
  misc_feature 1..70: note = Synthetic
  source 1..70: mol_type = other DNA
tgatggcagaggaccgggatactggaaaatatacgcggttctatctagttacgcgttaaaccaactagaa

SEQ ID NO: 4057 - DNA, 92 bp, synthetic construct
  misc_feature 1..92: note = Synthetic
  source 1..92: mol_type = other DNA
tggaggaagcagggcttcctttcctctgccatcacgtgctcagtctgttaataatcgcggttctatctagttacgcgttaaaccaactagaa

SEQ ID NO: 4058 - DNA, 91 bp, synthetic construct
  misc_feature 1..91: note = Synthetic
  source 1..91: mol_type = other DNA
tgatggcagaggaaaggaagccctgcttcctccaccgggatactggaaaaaaaacgcggttctatctagttacgcgttaaaccaactagaa

SEQ ID NO: 4059 - DNA, 84 bp, synthetic construct
  misc_feature 1..84: note = Synthetic
  source 1..84: mol_type = other DNA
tgcaggagctgcatcctctgccatcacgtgctcagtctgataaataacgcggttctatctagttacgcgttaaaccaactagaa

SEQ ID NO: 4060 - DNA, 83 bp, synthetic construct
  misc_feature 1..83: note = Synthetic
  source 1..83: mol_type = other DNA
tgatggcagaggatgcagctcctgcaccgggatactggaaaaaaggcgcggttctatctagttacgcgttaaaccaactagaa

SEQ ID NO: 4061 - DNA, 89 bp, synthetic construct
  misc_feature 1..89: note = Synthetic
  source 1..89: mol_type = other DNA
gcccagccaaacttgtcaaccagtatcccggcgtgctcagtctgttaaataccgcggttctatctagttacgcgttaaaccaactagaa

SEQ ID NO: 4062 - DNA, 88 bp, synthetic construct
  misc_feature 1..88: note = Synthetic
  source 1..88: mol_type = other DNA
gggtcaatccttggggcccagactgagcacgccgggatactggaaaataatcgcggttctatctagttacgcgttaaaccaactagaa

SEQ ID NO: 4063 - DNA, 47 bp, synthetic construct
  misc_feature 1..47: note = Synthetic
  source 1..47: mol_type = other DNA
ttgaataggaagtaaattaatttgaagctggaccctagggaaatcaa

SEQ ID NO: 4064 - DNA, 49 bp, synthetic construct
  misc_feature 1..49: note = Synthetic
  source 1..49: mol_type = other DNA
ttgaataggaagtaaattaatttgaagctggaccctagggaaatcaaag

SEQ ID NO: 4065 - DNA, 51 bp, synthetic construct
  misc_feature 1..51: note = Synthetic
  source 1..51: mol_type = other DNA
ttgaataggaagtaaattaatttgaagctggaccctagggaaatcaaagcc

SEQ ID NO: 4066 - DNA, 48 bp, synthetic construct
  misc_feature 1..48: note = Synthetic
  source 1..48: mol_type = other DNA
tagggtccagcttcaaattaatttacttcctattcaaagttcttaggc

SEQ ID NO: 4067 - DNA, 50 bp, synthetic construct
  misc_feature 1..50: note = Synthetic
  source 1..50: mol_type = other DNA
tagggtccagcttcaaattaatttacttcctattcaaagttcttaggcaa

SEQ ID NO: 4068 - DNA, 50 bp, synthetic construct
  misc_feature 1..50: note = Synthetic
  source 1..50: mol_type = other DNA
atgcctggacaagtaacttaagttaaataagccttctcagtaacaatcat

SEQ ID NO: 4069 - DNA, 46 bp, synthetic construct
  misc_feature 1..46: note = Synthetic
  source 1..46: mol_type = other DNA
agaaggcttatttaacttaagttacttgtccaggcatagttcttag

SEQ ID NO: 4070 - DNA, 40 bp, synthetic construct
  misc_feature 1..40: note = Synthetic
  source 1..40: mol_type = other DNA
tgctgagagagaaacagttgcctaagaactcagtaacaat

SEQ ID NO: 4071 - DNA, 41 bp, synthetic construct
  misc_feature 1..41: note = Synthetic
  source 1..41: mol_type = other DNA
accacttccacaatgtatatgattgttactgagttcttagg

SEQ ID NO: 4072 - DNA, 44 bp, synthetic construct
  misc_feature 1..44: note = Synthetic
  source 1..44: mol_type = other DNA
accacttccacaatgtatatgattgttactgagttcttaggcaa

SEQ ID NO: 4073 - DNA, 49 bp, synthetic construct
  misc_feature 1..49: note = Synthetic
  source 1..49: mol_type = other DNA
atgatcctgacgacggagaccgccgtcgtcgacaagcccagtaacaatc

SEQ ID NO: 4074 - DNA, 52 bp, synthetic construct
  misc_feature 1..52: note = Synthetic
  source 1..52: mol_type = other DNA
atgatcctgacgacggagaccgccgtcgtcgacaagcccagtaacaatcata

SEQ ID NO: 4075 - DNA, 49 bp, synthetic construct
  misc_feature 1..49: note = Synthetic
  source 1..49: mol_type = other DNA
ggcttgtcgacgacggcggtctccgtcgtcaggatcatagttcttaggc

SEQ ID NO: 4076 - DNA, 52 bp, synthetic construct
  misc_feature 1..52: note = Synthetic
  source 1..52: mol_type = other DNA
ggcttgtcgacgacggcggtctccgtcgtcaggatcatagttcttaggcaac

SEQ ID NO: 4077 - DNA, 50 bp, synthetic construct
  misc_feature 1..50: note = Synthetic
  source 1..50: mol_type = other DNA
ggcttgtcgacgacggcggtctccgtcgtcaggatcatatcactttactc

SEQ ID NO: 4078 - DNA, 53 bp, synthetic construct
  misc_feature 1..53: note = Synthetic
  source 1..53: mol_type = other DNA
ggcttgtcgacgacggcggtctccgtcgtcaggatcatatcactttactctcc

SEQ ID NO: 4079 - DNA, 52 bp, synthetic construct
  misc_feature 1..52: note = Synthetic
  source 1..52: mol_type = other DNA
taccgtacaccactgagaccgcggtggttgaccagacaaacctggggttcct

SEQ ID NO: 4080 - DNA, 54 bp, synthetic construct
  misc_feature 1..54: note = Synthetic
  source 1..54: mol_type = other DNA
taccgtacaccactgagaccgcggtggttgaccagacaaacctggggttcctgg

SEQ ID NO: 4081 - DNA, 56 bp, synthetic construct
  misc_feature 1..56: note = Synthetic
  source 1..56: mol_type = other DNA
taccgtacaccactgagaccgcggtggttgaccagacaaacctggggttcctggct

SEQ ID NO: 4082 - DNA, 52 bp, synthetic construct
  misc_feature 1..52: note = Synthetic
  source 1..52: mol_type = other DNA
taccgtacaccactgagaccgcggtggttgaccagacaaacctctctcctgc

SEQ ID NO: 4083 - DNA, 54 bp, synthetic construct
  misc_feature 1..54: note = Synthetic
  source 1..54: mol_type = other DNA
taccgtacaccactgagaccgcggtggttgaccagacaaacctctctcctgccc

SEQ ID NO: 4084 - DNA, 56 bp, synthetic construct
  misc_feature 1..56: note = Synthetic
  source 1..56: mol_type = other DNA
taccgtacaccactgagaccgcggtggttgaccagacaaacctctctcctgcccct

SEQ ID NO: 4085 - DNA, 52 bp, synthetic construct
  misc_feature 1..52: note = Synthetic
  source 1..52: mol_type = other DNA
taccgtacaccactgagaccgcggtggttgaccagacaaacctctatctggg

SEQ ID NO: 4086 - DNA, 54 bp, synthetic construct
  misc_feature 1..54: note = Synthetic
  source 1..54: mol_type = other DNA
taccgtacaccactgagaccgcggtggttgaccagacaaacctctatctgggac

SEQ ID NO: 4087 - DNA, 56 bp, synthetic construct
  misc_feature 1..56: note = Synthetic
  source 1..56: mol_type = other DNA
taccgtacaccactgagaccgcggtggttgaccagacaaacctctatctgggacat

SEQ ID NO: 4088 - DNA, 52 bp, synthetic construct
  misc_feature 1..52: note = Synthetic
  source 1..52: mol_type = other DNA
taccgtacaccactgagaccgcggtggttgaccagacaaacctttccttaaa

SEQ ID NO: 4089 - DNA, 54 bp, synthetic construct
  misc_feature 1..54: note = Synthetic
  source 1..54: mol_type = other DNA
taccgtacaccactgagaccgcggtggttgaccagacaaacctttccttaaaga

SEQ ID NO: 4090 - DNA, 56 bp, synthetic construct
  misc_feature 1..56: note = Synthetic
  source 1..56: mol_type = other DNA
taccgtacaccactgagaccgcggtggttgaccagacaaacctttccttaaagagt

SEQ ID NO: 4091 - DNA, 52 bp, synthetic construct
  misc_feature 1..52: note = Synthetic
  source 1..52: mol_type = other DNA
taccgtacaccactgagaccgcggtggttgaccagacaaacctctccctttc

SEQ ID NO: 4092 - DNA, 54 bp, synthetic construct
  misc_feature 1..54: note = Synthetic
  source 1..54: mol_type = other DNA
taccgtacaccactgagaccgcggtggttgaccagacaaacctctccctttctc

SEQ ID NO: 4093 - DNA, 56 bp, synthetic construct
  misc_feature 1..56: note = Synthetic
  source 1..56: mol_type = other DNA
taccgtacaccactgagaccgcggtggttgaccagacaaacctctccctttctctt

SEQ ID NO: 4094 - DNA, 52 bp, synthetic construct
  misc_feature 1..52: note = Synthetic
  source 1..52: mol_type = other DNA
taccgtacaccactgagaccgcggtggttgaccagacaaacctcgtggccgc

SEQ ID NO: 4095 - DNA, 54 bp, synthetic construct
  misc_feature 1..54: note = Synthetic
  source 1..54: mol_type = other DNA
taccgtacaccactgagaccgcggtggttgaccagacaaacctcgtggccgcct

SEQ ID NO: 4096 - DNA, 56 bp, synthetic construct
  misc_feature 1..56: note = Synthetic
  source 1..56: mol_type = other DNA
taccgtacaccactgagaccgcggtggttgaccagacaaacctcgtggccgcctct

SEQ ID NO: 4097 - DNA, 52 bp, synthetic construct
  misc_feature 1..52: note = Synthetic
  source 1..52: mol_type = other DNA
taccgtacaccactgagaccgcggtggttgaccagacaaacctggtgcgttt

SEQ ID NO: 4098 - DNA, 54 bp, synthetic construct
  misc_feature 1..54: note = Synthetic
  source 1..54: mol_type = other DNA
taccgtacaccactgagaccgcggtggttgaccagacaaacctggtgcgtttca

SEQ ID NO: 4099 - DNA, 56 bp, synthetic construct
  misc_feature 1..56: note = Synthetic
  source 1..56: mol_type = other DNA
taccgtacaccactgagaccgcggtggttgaccagacaaacctggtgcgtttcact

SEQ ID NO: 4100 - DNA, 52 bp, synthetic construct
  misc_feature 1..52: note = Synthetic
  source 1..52: mol_type = other DNA
taccgtacaccactgagaccgcggtggttgaccagacaaacctcccagaacc

SEQ ID NO: 4101 - DNA, 54 bp, synthetic construct
  misc_feature 1..54: note = Synthetic
  source 1..54: mol_type = other DNA
taccgtacaccactgagaccgcggtggttgaccagacaaacctcccagaacctg

SEQ ID NO: 4102 - DNA, 56 bp, synthetic construct
  misc_feature 1..56: note = Synthetic
  source 1..56: mol_type = other DNA
taccgtacaccactgagaccgcggtggttgaccagacaaacctcccagaacctgag

SEQ ID NO: 4103 - DNA, 52 bp, synthetic construct
  misc_feature 1..52: note = Synthetic
  source 1..52: mol_type = other DNA
taccgtacaccactgagaccgcggtggttgaccagacaaacctcggttctca

SEQ ID NO: 4104 - DNA, 54 bp, synthetic construct
  misc_feature 1..54: note = Synthetic
  source 1..54: mol_type = other DNA
taccgtacaccactgagaccgcggtggttgaccagacaaacctcggttctcagt

SEQ ID NO: 4105 - DNA, 56 bp, synthetic construct
  misc_feature 1..56: note = Synthetic
  source 1..56: mol_type = other DNA
taccgtacaccactgagaccgcggtggttgaccagacaaacctcggttctcagtgg

SEQ ID NO: 4106 - DNA, 52 bp, synthetic construct
  misc_feature 1..52: note = Synthetic
  source 1..52: mol_type = other DNA
taccgtacaccactgagaccgcggtggttgaccagacaaaccttcctgttag

SEQ ID NO: 4107 - DNA, 54 bp, synthetic construct
  misc_feature 1..54: note = Synthetic
  source 1..54: mol_type = other DNA
taccgtacaccactgagaccgcggtggttgaccagacaaaccttcctgttaggc

SEQ ID NO: 4108 - DNA, 56 bp, synthetic construct
  misc_feature 1..56: note = Synthetic
  source 1..56: mol_type = other DNA
taccgtacaccactgagaccgcggtggttgaccagacaaaccttcctgttaggcag

SEQ ID NO: 4109 - DNA, 52 bp, synthetic construct
  misc_feature 1..52: note = Synthetic
  source 1..52: mol_type = other DNA
taccgtacaccactgagaccgcggtggttgaccagacaaacctgggacagga

SEQ ID NO: 4110 - DNA, 54 bp, synthetic construct
  misc_feature 1..54: note = Synthetic
  source 1..54: mol_type = other DNA
taccgtacaccactgagaccgcggtggttgaccagacaaacctgggacaggatt

SEQ ID NO: 4111 - DNA, 56 bp, synthetic construct
  misc_feature 1..56: note = Synthetic
  source 1..56: mol_type = other DNA
taccgtacaccactgagaccgcggtggttgaccagacaaacctgggacaggattgg

SEQ ID NO: 4112 - DNA, 52 bp, synthetic construct
  misc_feature 1..52: note = Synthetic
  source 1..52: mol_type = other DNA
taccgtacaccactgagaccgcggtggttgaccagacaaacctggcggtggg

SEQ ID NO: 4113 - DNA, 54 bp, synthetic construct
  misc_feature 1..54: note = Synthetic
  source 1..54: mol_type = other DNA
taccgtacaccactgagaccgcggtggttgaccagacaaacctggcggtggggg

SEQ ID NO: 4114 - DNA, 56 bp, synthetic construct
  misc_feature 1..56: note = Synthetic
  source 1..56: mol_type = other DNA
taccgtacaccactgagaccgcggtggttgaccagacaaacctggcggtggggggc

SEQ ID NO: 4115 - DNA, 52 bp, synthetic construct
  misc_feature 1..52: note = Synthetic
  source 1..52: mol_type = other DNA
taccgtacaccactgagaccgcggtggttgaccagacaaacctggcagcgcc

SEQ ID NO: 4116 - DNA, 54 bp, synthetic construct
  misc_feature 1..54: note = Synthetic
  source 1..54: mol_type = other DNA
taccgtacaccactgagaccgcggtggttgaccagacaaacctggcagcgccgt

SEQ ID NO: 4117 - DNA, 56 bp, synthetic construct
  misc_feature 1..56: note = Synthetic
  source 1..56: mol_type = other DNA
taccgtacaccactgagaccgcggtggttgaccagacaaacctggcagcgccgtga

SEQ ID NO: 4118 - DNA, 52 bp, synthetic construct
  misc_feature 1..52: note = Synthetic
  source 1..52: mol_type = other DNA
taccgtacaccactgagaccgcggtggttgaccagacaaacctgacctgccc

SEQ ID NO: 4119 - DNA, 54 bp, synthetic construct
  misc_feature 1..54: note = Synthetic
  source 1..54: mol_type = other DNA
taccgtacaccactgagaccgcggtggttgaccagacaaacctgacctgcccag

SEQ ID NO: 4120 - DNA, 56 bp, synthetic construct
  misc_feature 1..56: note = Synthetic
  source 1..56: mol_type = other DNA
taccgtacaccactgagaccgcggtggttgaccagacaaacctgacctgcccagca

SEQ ID NO: 4121 - DNA, 53 bp, synthetic construct
  misc_feature 1..53: note = Synthetic
  source 1..53: mol_type = other DNA
gtctggtcaaccaccgcggtctcagtggtgtacggtacaaacctctgggcttg

SEQ ID NO: 4122 - DNA, 55 bp, synthetic construct
  misc_feature 1..55: note = Synthetic
  source 1..55: mol_type = other DNA
gtctggtcaaccaccgcggtctcagtggtgtacggtacaaacctctgggcttgcc

SEQ ID NO: 4123 - DNA, 57 bp, synthetic construct
  misc_feature 1..57: note = Synthetic
  source 1..57: mol_type = other DNA
ctctggtcaaccaccgcggtctcagtggtgtacggtacaaacctctgggcttgccaa

SEQ ID NO: 4124 - DNA, 53 bp, synthetic construct
  misc_feature 1..53: note = Synthetic
  source 1..53: mol_type = other DNA
gtctggtcaaccaccgcggtctcagtggtgtacggtacaaacctgaacaccta

SEQ ID NO: 4125 - DNA, 55 bp, synthetic construct
  misc_feature 1..55: note = Synthetic
  source 1..55: mol_type = other DNA
gtctggtcaaccaccgcggtctcagtggtgtacggtacaaacctgaacacctagg

SEQ ID NO: 4126 - DNA, 56 bp, synthetic construct
  misc_feature 1..56: note = Synthetic
  source 1..56: mol_type = other DNA
tctggtcaaccaccgcggtctcagtggtgtacggtacaaacctgaacacctaggac

SEQ ID NO: 4127 - DNA, 53 bp, synthetic construct
  misc_feature 1..53: note = Synthetic
  source 1..53: mol_type = other DNA
gtctggtcaaccaccgcggtctcagtggtgtacggtacaaacctcacagccct

SEQ ID NO: 4128 - DNA, 55 bp, synthetic construct
  misc_feature 1..55: note = Synthetic
  source 1..55: mol_type = other DNA
gtctggtcaaccaccgcggtctcagtggtgtacggtacaaacctcacagccctgc

SEQ ID NO: 4129 - DNA, 56 bp, synthetic construct
  misc_feature 1..56: note = Synthetic
  source 1..56: mol_type = other DNA
tctggtcaaccaccgcggtctcagtggtgtacggtacaaacctcacagccctgcca

SEQ ID NO: 4130 - DNA, 53 bp, synthetic construct
  misc_feature 1..53: note = Synthetic
  source 1..53: mol_type = other DNA
gtctggtcaaccaccgcggtctcagtggtgtacggtacaaacctagaaccggg

SEQ ID NO: 4131 - DNA, 55 bp, synthetic construct
  misc_feature 1..55: note = Synthetic
  source 1..55: mol_type = other DNA
gtctggtcaaccaccgcggtctcagtggtgtacggtacaaacctagaaccgggca

SEQ ID NO: 4132 - DNA, 56 bp, synthetic construct
  misc_feature 1..56: note = Synthetic
  source 1..56: mol_type = other DNA
tctggtcaaccaccgcggtctcagtggtgtacggtacaaacctagaaccgggcagg

SEQ ID NO: 4133 - DNA, 53 bp, synthetic construct
  misc_feature 1..53: note = Synthetic
  source 1..53: mol_type = other DNA
gtctggtcaaccaccgcggtctcagtggtgtacggtacaaacctcaccccctg

SEQ ID NO: 4134 - DNA, 55 bp, synthetic construct
  misc_feature 1..55: note = Synthetic
  source 1..55: mol_type = other DNA
gtctggtcaaccaccgcggtctcagtggtgtacggtacaaacctcaccccctgcc

SEQ ID NO: 4135 - DNA, 56 bp, synthetic construct
  misc_feature 1..56: note = Synthetic
  source 1..56: mol_type = other DNA
tctggtcaaccaccgcggtctcagtggtgtacggtacaaacctcaccccctgccaa

SEQ ID NO: 4136 - DNA, 53 bp, synthetic construct
  misc_feature 1..53: note = Synthetic
  source 1..53: mol_type = other DNA
gtctggtcaaccaccgcggtctcagtggtgtacggtacaaacctaggatcctc

SEQ ID NO: 4137 - DNA, 55 bp, synthetic construct
  misc_feature 1..55: note = Synthetic
  source 1..55: mol_type = other DNA
gtctggtcaaccaccgcggtctcagtggtgtacggtacaaacctaggatcctctc

SEQ ID NO: 4138 - DNA, 56 bp, synthetic construct
  misc_feature 1..56: note = Synthetic
  source 1..56: mol_type = other DNA
tctggtcaaccaccgcggtctcagtggtgtacggtacaaacctaggatcctctctg

SEQ ID NO: 4139 - DNA, 53 bp, synthetic construct
  misc_feature 1..53: note = Synthetic
  source 1..53: mol_type = other DNA
gtctggtcaaccaccgcggtctcagtggtgtacggtacaaaccttcctctctg

SEQ ID NO: 4140 - DNA, 55 bp, synthetic construct
  misc_feature 1..55: note = Synthetic
  source 1..55: mol_type = other DNA
gtctggtcaaccaccgcggtctcagtggtgtacggtacaaaccttcctctctggc

SEQ ID NO: 4141 - DNA, 56 bp, synthetic construct
  misc_feature 1..56: note = Synthetic
  source 1..56: mol_type = other DNA
tctggtcaaccaccgcggtctcagtggtgtacggtacaaaccttcctctctggctc

SEQ ID NO: 4142 - DNA, 53 bp, synthetic construct
  misc_feature 1..53: note = Synthetic
  source 1..53: mol_type = other DNA
gtctggtcaaccaccgcggtctcagtggtgtacggtacaaacctctgtcccta

SEQ ID NO: 4143 - DNA, 55 bp, synthetic construct
  misc_feature 1..55: note = Synthetic
  source 1..55: mol_type = other DNA
gtctggtcaaccaccgcggtctcagtggtgtacggtacaaacctctgtccctagt

SEQ ID NO: 4144 - DNA, 56 bp, synthetic construct
  misc_feature 1..56: note = Synthetic
  source 1..56: mol_type = other DNA
tctggtcaaccaccgcggtctcagtggtgtacggtacaaacctctgtccctagtgg

SEQ ID NO: 4145 - DNA, 53 bp, synthetic construct
  misc_feature 1..53: note = Synthetic
  source 1..53: mol_type = other DNA
gtctggtcaaccaccgcggtctcagtggtgtacggtacaaaccttgtggggtg

SEQ ID NO: 4146 - DNA, 55 bp, synthetic construct
  misc_feature 1..55: note = Synthetic
  source 1..55: mol_type = other DNA
gtctggtcaaccaccgcggtctcagtggtgtacggtacaaaccttgtggggtgga

SEQ ID NO: 4147 - DNA, 56 bp, synthetic construct
  misc_feature 1..56: note = Synthetic
  source 1..56: mol_type = other DNA
tctggtcaaccaccgcggtctcagtggtgtacggtacaaaccttgtggggtggagg

SEQ ID NO: 4148 - DNA, 53 bp, synthetic construct
  misc_feature 1..53: note = Synthetic
  source 1..53: mol_type = other DNA
gtctggtcaaccaccgcggtctcagtggtgtacggtacaaacctgaatataag

SEQ ID NO: 4149 - DNA, 55 bp, synthetic construct
  misc_feature 1..55: note = Synthetic
  source 1..55: mol_type = other DNA
gtctggtcaaccaccgcggtctcagtggtgtacggtacaaacctgaatataaggt

SEQ ID NO: 4150 - DNA, 56 bp, synthetic construct
  misc_feature 1..56: note = Synthetic
  source 1..56: mol_type = other DNA
tctggtcaaccaccgcggtctcagtggtgtacggtacaaacctgaatataaggtgg

SEQ ID NO: 4151 - DNA, 53 bp, synthetic construct
  misc_feature 1..53: note = Synthetic
  source 1..53: mol_type = other DNA
gtctggtcaaccaccgcggtctcagtggtgtacggtacaaacctggtgtgctg

SEQ ID NO: 4152 - DNA, 55 bp, synthetic construct
  misc_feature 1..55: note = Synthetic
  source 1..55: mol_type = other DNA
gtctggtcaaccaccgcggtctcagtggtgtacggtacaaacctggtgtgctggg

SEQ ID NO: 4153 - DNA, 56 bp, synthetic construct
  misc_feature 1..56: note = Synthetic
  source 1..56: mol_type = other DNA
tctggtcaaccaccgcggtctcagtggtgtacggtacaaacctggtgtgctgggca

SEQ ID NO: 4154 - DNA, 53 bp, synthetic construct
  misc_feature 1..53: note = Synthetic
  source 1..53: mol_type = other DNA
gtctggtcaaccaccgcggtctcagtggtgtacggtacaaacctccacttcca

SEQ ID NO: 4155 - DNA, 55 bp, synthetic construct
  misc_feature 1..55: note = Synthetic
  source 1..55: mol_type = other DNA
gtctggtcaaccaccgcggtctcagtggtgtacggtacaaacctccacttccagg

SEQ ID NO: 4156 - DNA, 56 bp, synthetic construct
  misc_feature 1..56: note = Synthetic
  source 1..56: mol_type = other DNA
tctggtcaaccaccgcggtctcagtggtgtacggtacaaacctccacttccaggag

SEQ ID NO: 4157 - DNA, 53 bp, synthetic construct
  misc_feature 1..53: note = Synthetic
  source 1..53: mol_type = other DNA
gtctggtcaaccaccgcggtctcagtggtgtacggtacaaaccttgcacactg

SEQ ID NO: 4158 - DNA, 55 bp, synthetic construct
  misc_feature 1..55: note = Synthetic
  source 1..55: mol_type = other DNA
gtctggtcaaccaccgcggtctcagtggtgtacggtacaaaccttgcacactggg

SEQ ID NO: 4159 - DNA, 56 bp, synthetic construct
  misc_feature 1..56: note = Synthetic
  source 1..56: mol_type = other DNA
tctggtcaaccaccgcggtctcagtggtgtacggtacaaaccttgcacactgggaa

SEQ ID NO: 4160 - DNA, 48 bp, synthetic construct
  misc_feature 1..48: note = Synthetic
  source 1..48: mol_type = other DNA
atgatcctgacgacggagaccgccgtcgtcgacaagccgcagtttatc

SEQ ID NO: 4161 - DNA, 50 bp, synthetic construct
  misc_feature 1..50: note = Synthetic
  source 1..50: mol_type = other DNA
atgatcctgacgacggagaccgccgtcgtcgacaagccgcagtttatcag

SEQ ID NO: 4162 - DNA, 51 bp, synthetic construct
  misc_feature 1..51: note = Synthetic
  source 1..51: mol_type = other DNA
atgatcctgacgacggagaccgccgtcgtcgacaagccgcagtttatcagg

SEQ ID NO: 4163 - DNA, 47 bp, synthetic construct
  misc_feature 1..47: note = Synthetic
  source 1..47: mol_type = other DNA
atgatcctgacgacggagaccgccgtcgtcgacaagcctgagcaggt

SEQ ID NO: 4164 - DNA, 49 bp, synthetic construct
  misc_feature 1..49: note = Synthetic
  source 1..49: mol_type = other DNA
atgatcctgacgacggagaccgccgtcgtcgacaagcctgagcaggtag

SEQ ID NO: 4165 - DNA, 51 bp, synthetic construct
  misc_feature 1..51: note = Synthetic
  source 1..51: mol_type = other DNA
atgatcctgacgacggagaccgccgtcgtcgacaagcctgagcaggtagat

SEQ ID NO: 4166 - DNA, 47 bp, synthetic construct
  misc_feature 1..47: note = Synthetic
  source 1..47: mol_type = other DNA
atgatcctgacgacggagaccgccgtcgtcgacaagccggcggcagc

SEQ ID NO: 4167 - DNA, 49 bp, synthetic construct
  misc_feature 1..49: note = Synthetic
  source 1..49: mol_type = other DNA
atgatcctgacgacggagaccgccgtcgtcgacaagccggcggcagcat

SEQ ID NO: 4168 - DNA, 51 bp, synthetic construct
  misc_feature 1..51: note = Synthetic
  source 1..51: mol_type = other DNA
atgatcctgacgacggagaccgccgtcgtcgacaagccggcggcagcatag

SEQ ID NO: 4169 - DNA, 48 bp, synthetic construct
  misc_feature 1..48: note = Synthetic
  source 1..48: mol_type = other DNA
atgatcctgacgacggagaccgccgtcgtcgacaagccaagagttgac

SEQ ID NO: 4170 - DNA, 50 bp, synthetic construct
  misc_feature 1..50: note = Synthetic
  source 1..50: mol_type = other DNA
atgatcctgacgacggagaccgccgtcgtcgacaagccaagagttgacac

SEQ ID NO: 4171 - DNA, 51 bp, synthetic construct
  misc_feature 1..51: note = Synthetic
  source 1..51: mol_type = other DNA
atgatcctgacgacggagaccgccgtcgtcgacaagccaagagttgacaca

SEQ ID NO: 4172 - DNA, 48 bp, synthetic construct
  misc_feature 1..48: note = Synthetic
  source 1..48: mol_type = other DNA
atgatcctgacgacggagaccgccgtcgtcgacaagccaagtgatcac

SEQ ID NO: 4173 - DNA, 50 bp, synthetic construct
  misc_feature 1..50: note = Synthetic
  source 1..50: mol_type = other DNA
atgatcctgacgacggagaccgccgtcgtcgacaagccaagtgatcacac

SEQ ID NO: 4174 - DNA, 52 bp, synthetic construct
  misc_feature 1..52: note = Synthetic
  source 1..52: mol_type = other DNA
atgatcctgacgacggagaccgccgtcgtcgacaagccaagtgatcacactt

SEQ ID NO: 4175 - DNA, 47 bp, synthetic construct
  misc_feature 1..47: note = Synthetic
  source 1..47: mol_type = other DNA
atgatcctgacgacggagaccgccgtcgtcgacaagcccccaagtga

SEQ ID NO: 4176 - DNA, 49 bp, synthetic construct
  misc_feature 1..49: note = Synthetic
  source 1..49: mol_type = other DNA
atgatcctgacgacggagaccgccgtcgtcgacaagcccccaagtgatc

SEQ ID NO: 4177 - DNA, 51 bp, synthetic construct
  misc_feature 1..51: note = Synthetic
  source 1..51: mol_type = other DNA
atgatcctgacgacggagaccgccgtcgtcgacaagcccccaagtgatcac

SEQ ID NO: 4178 - DNA, 47 bp, synthetic construct
  misc_feature 1..47: note = Synthetic
  source 1..47: mol_type = other DNA
atgatcctgacgacggagaccgccgtcgtcgacaagccagagacgca

SEQ ID NO: 4179 - DNA, 49 bp, synthetic construct
  misc_feature 1..49: note = Synthetic
  source 1..49: mol_type = other DNA
atgatcctgacgacggagaccgccgtcgtcgacaagccagagacgcaaa

SEQ ID NO: 4180 - DNA, 51 bp, synthetic construct
  misc_feature 1..51: note = Synthetic
  source 1..51: mol_type = other DNA
atgatcctgacgacggagaccgccgtcgtcgacaagccagagacgcaaaca

SEQ ID NO: 4181 - DNA, 46 bp, synthetic construct
  misc_feature 1..46: note = Synthetic
  source 1..46: mol_type = other DNA
ggcttgtcgacgacggcggtctccgtcgtcaggatcatctgacctg

SEQ ID NO: 4182 - DNA, 47 bp, synthetic construct
  misc_feature 1..47: note = Synthetic
  source 1..47: mol_type = other DNA
ggcttgtcgacgacggcggtctccgtcgtcaggatcatctgacctgt

SEQ ID NO: 4183 - DNA, 49 bp, synthetic construct
  misc_feature 1..49: note = Synthetic
  source 1..49: mol_type = other DNA
ggcttgtcgacgacggcggtctccgtcgtcaggatcatctgacctgttt

SEQ ID NO: 4184 - DNA, 47 bp, synthetic construct
  misc_feature 1..47: note = Synthetic
  source 1..47: mol_type = other DNA
ggcttgtcgacgacggcggtctccgtcgtcaggatcattactgtccc

SEQ ID NO: 4185 - DNA, 49 bp, synthetic construct
  misc_feature 1..49: note = Synthetic
  source 1..49: mol_type = other DNA
ggcttgtcgacgacggcggtctccgtcgtcaggatcattactgtcccct

SEQ ID NO: 4186 - DNA, 51 bp, synthetic construct
  misc_feature 1..51: note = Synthetic
  source 1..51: mol_type = other DNA
ggcttgtcgacgacggcggtctccgtcgtcaggatcattactgtccccttc

SEQ ID NO: 4187 - DNA, 47 bp, synthetic construct
  misc_feature 1..47: note = Synthetic
  source 1..47: mol_type = other DNA
ggcttgtcgacgacggcggtctccgtcgtcaggatcatgggctcact

SEQ ID NO: 4188 - DNA, 49 bp, synthetic construct
  misc_feature 1..49: note = Synthetic
  source 1..49: mol_type = other DNA
ggcttgtcgacgacggcggtctccgtcgtcaggatcatgggctcactat

SEQ ID NO: 4189 - DNA, 51 bp, synthetic construct
  misc_feature 1..51: note = Synthetic
  source 1..51: mol_type = other DNA
ggcttgtcgacgacggcggtctccgtcgtcaggatcatgggctcactatgc

SEQ ID NO: 4190 - DNA, 47 bp, synthetic construct
  misc_feature 1..47: note = Synthetic
  source 1..47: mol_type = other DNA
ggcttgtcgacgacggcggtctccgtcgtcaggatcatagtgggact

SEQ ID NO: 4191 - DNA, 50 bp, synthetic construct
  misc_feature 1..50: note = Synthetic
  source 1..50: mol_type = other DNA
ggcttgtcgacgacggcggtctccgtcgtcaggatcatagtgggactttg

SEQ ID NO: 4192 - DNA, 51 bp, synthetic construct
  misc_feature 1..51: note = Synthetic
  source 1..51: mol_type = other DNA
ggcttgtcgacgacggcggtctccgtcgtcaggatcatagtgggactttgg

SEQ ID NO: 4193 - DNA, 47 bp, synthetic construct
  misc_feature 1..47: note = Synthetic
  source 1..47: mol_type = other DNA
ggcttgtcgacgacggcggtctccgtcgtcaggatcatggactttgg

SEQ ID NO: 4194 - DNA, 49 bp, synthetic construct
  misc_feature 1..49: note = Synthetic
  source 1..49: mol_type = other DNA
ggcttgtcgacgacggcggtctccgtcgtcaggatcatggactttggaa

SEQ ID NO: 4195 - DNA, 51 bp, synthetic construct
  misc_feature 1..51: note = Synthetic
  source 1..51: mol_type = other DNA
ggcttgtcgacgacggcggtctccgtcgtcaggatcatggactttggaaat

SEQ ID NO: 4196 - DNA, 47 bp, synthetic construct
  misc_feature 1..47: note = Synthetic
  source 1..47: mol_type = other DNA
ggcttgtcgacgacggcggtctccgtcgtcaggatcatgacaatcga

SEQ ID NO: 4197 - DNA, 49 bp, synthetic construct
  misc_feature 1..49: note = Synthetic
  source 1..49: mol_type = other DNA
ggcttgtcgacgacggcggtctccgtcgtcaggatcatgacaatcgata

SEQ ID NO: 4198 - DNA, 51 bp, synthetic construct
  misc_feature 1..51: note = Synthetic
  source 1..51: mol_type = other DNA
ggcttgtcgacgacggcggtctccgtcgtcaggatcatgacaatcgatagg

SEQ ID NO: 4199 - DNA, 48 bp, synthetic construct
  misc_feature 1..48: note = Synthetic
  source 1..48: mol_type = other DNA
ggcttgtcgacgacggcggtctccgtcgtcaggatcatatcatcttta

SEQ ID NO: 4200 - DNA, 50 bp, synthetic construct
  misc_feature 1..50: note = Synthetic
  source 1..50: mol_type = other DNA
ggcttgtcgacgacggcggtctccgtcgtcaggatcatatcatctttacc

SEQ ID NO: 4201 - DNA, 52 bp, synthetic construct
  misc_feature 1..52: note = Synthetic
  source 1..52: mol_type = other DNA
ggcttgtcgacgacggcggtctccgtcgtcaggatcatatcatctttaccag

SEQ ID NO: 4202 - DNA, 47 bp, synthetic construct
  misc_feature 1..47: note = Synthetic
  source 1..47: mol_type = other DNA
ggcttgtcgacgacggcggtctccgtcgtcaggatcatgctctcatt

SEQ ID NO: 4203 - DNA, 50 bp, synthetic construct
  misc_feature 1..50: note = Synthetic
  source 1..50: mol_type = other DNA
ggcttgtcgacgacggcggtctccgtcgtcaggatcatgctctcattttc

SEQ ID NO: 4204 - DNA, 52 bp, synthetic construct
  misc_feature 1..52: note = Synthetic
  source 1..52: mol_type = other DNA
ggcttgtcgacgacggcggtctccgtcgtcaggatcatgctctcattttcca

SEQ ID NO: 4205 - DNA, 47 bp, synthetic construct
  misc_feature 1..47: note = Synthetic
  source 1..47: mol_type = other DNA
ggcttgtcgacgacggcggtctccgtcgtcaggatcatagtcagtat

SEQ ID NO: 4206 - DNA, 49 bp, synthetic construct
  misc_feature 1..49: note = Synthetic
  source 1..49: mol_type = other DNA
ggcttgtcgacgacggcggtctccgtcgtcaggatcatagtcagtatca

SEQ ID NO: 4207 - DNA, 51 bp, synthetic construct
  misc_feature 1..51: note = Synthetic
  source 1..51: mol_type = other DNA
ggcttgtcgacgacggcggtctccgtcgtcaggatcatagtcagtatcaat

SEQ ID NO: 4208 - DNA, 45 bp, synthetic construct
  misc_feature 1..45: note = Synthetic
  source 1..45: mol_type = other DNA
tcctgacgacggagaccgccgtcgtcgacaagccagagacgcaaa

SEQ ID NO: 4209 - DNA, 46 bp, synthetic construct
  misc_feature 1..46: note = Synthetic
  source 1..46: mol_type = other DNA
tgtcgacgacggcggtctccgtcgtcaggatcatgctctcattttc

SEQ ID NO: 4210 - DNA, 40 bp, synthetic construct
  misc_feature 1..40: note = Synthetic
  source 1..40: mol_type = other DNA
acgacggagaccgccgtcgtcgacaagccagagacgcaaa

SEQ ID NO: 4211 - DNA, 41 bp, synthetic construct
  misc_feature 1..41: note = Synthetic
  source 1..41: mol_type = other DNA
acgacggcggtctccgtcgtcaggatcatgctctcattttc

SEQ ID NO: 4212 - DNA, 49 bp, synthetic construct
  misc_feature 1..49: note = Synthetic
  source 1..49: mol_type = other DNA
atgatcctgacgacggagtccgccgtcgtcgacaagccagagacgcaaa

SEQ ID NO: 4213 - DNA, 50 bp, synthetic construct
  misc_feature 1..50: note = Synthetic
  source 1..50: mol_type = other DNA
ggcttgtcgacgacggcggactccgtcgtcaggatcatgctctcattttc

SEQ ID NO: 4214 - DNA, 45 bp, synthetic construct
  misc_feature 1..45: note = Synthetic
  source 1..45: mol_type = other DNA
tcctgacgacggagtccgccgtcgtcgacaagccagagacgcaaa

SEQ ID NO: 4215 - DNA, 46 bp, synthetic construct
  misc_feature 1..46: note = Synthetic
  source 1..46: mol_type = other DNA
tgtcgacgacggcggactccgtcgtcaggatcatgctctcattttc

SEQ ID NO: 4216 - DNA, 40 bp, synthetic construct
  misc_feature 1..40: note = Synthetic
  source 1..40: mol_type = other DNA
acgacggagtccgccgtcgtcgacaagccagagacgcaaa

SEQ ID NO: 4217 - DNA, 41 bp, synthetic construct
  misc_feature 1..41: note = Synthetic
  source 1..41: mol_type = other DNA
acgacggcggactccgtcgtcaggatcatgctctcattttc

SEQ ID NO: 4218 - DNA, 61 bp, synthetic construct
  misc_feature 1..61: note = Synthetic
  source 1..61: mol_type = other DNA
gggtttgtaccgtacaccactgagaccgcggtggttgaccagacaaaccaagagacgcaaa

SEQ ID NO: 4219 - DNA, 62 bp, synthetic construct
  misc_feature 1..62: note = Synthetic
  source 1..62: mol_type = other DNA
tggtttgtctggtcaaccaccgcggtctcagtggtgtacggtacaaacccgctctcattttc

SEQ ID NO: 4220 - DNA, 56 bp, synthetic construct
  misc_feature 1..56: note = Synthetic
  source 1..56: mol_type = other DNA
tgtaccgtacaccactgagaccgcggtggttgaccagacaaaccaagagacgcaaa

SEQ ID NO: 4221 - DNA, 57 bp, synthetic construct
  misc_feature 1..57: note = Synthetic
  source 1..57: mol_type = other DNA
tgtctggtcaaccaccgcggtctcagtggtgtacggtacaaacccgctctcattttc

SEQ ID NO: 4222 - DNA, 51 bp, synthetic construct
  misc_feature 1..51: note = Synthetic
  source 1..51: mol_type = other DNA
cgtacaccactgagaccgcggtggttgaccagacaaaccaagagacgcaaa

SEQ ID NO: 4223 - DNA, 52 bp, synthetic construct
  misc_feature 1..52: note = Synthetic
  source 1..52: mol_type = other DNA
ggtcaaccaccgcggtctcagtggtgtacggtacaaacccgctctcattttc

SEQ ID NO: 4224 - DNA, 61 bp, synthetic construct
  misc_feature 1..61: note = Synthetic
  source 1..61: mol_type = other DNA
gggtttgtaccgtacaccactgagtccgcggtggttgaccagacaaaccaagagacgcaaa

SEQ ID NO: 4225 - DNA, 62 bp, synthetic construct
  misc_feature 1..62: note = Synthetic
  source 1..62: mol_type = other DNA
tggtttgtctggtcaaccaccgcggactcagtggtgtacggtacaaacccgctctcattttc

SEQ ID NO: 4226 - DNA, 56 bp, synthetic construct
  misc_feature 1..56: note = Synthetic
  source 1..56: mol_type = other DNA
tgtaccgtacaccactgagtccgcggtggttgaccagacaaaccaagagacgcaaa

SEQ ID NO: 4227 - DNA, 57 bp, synthetic construct
  misc_feature 1..57: note = Synthetic
  source 1..57: mol_type = other DNA
tgtctggtcaaccaccgcggactcagtggtgtacggtacaaacccgctctcattttc

SEQ ID NO: 4228 - DNA, 51 bp, synthetic construct
  misc_feature 1..51: note = Synthetic
  source 1..51: mol_type = other DNA
cgtacaccactgagtccgcggtggttgaccagacaaaccaagagacgcaaa

SEQ ID NO: 4229 - DNA, 52 bp, synthetic construct
  misc_feature 1..52: note = Synthetic
  source 1..52: mol_type = other DNA
ggtcaaccaccgcggactcagtggtgtacggtacaaacccgctctcattttc

SEQ ID NO: 4230 - DNA, 49 bp, synthetic construct
  misc_feature 1..49: note = Synthetic
  source 1..49: mol_type = other DNA
aacttcacagaggcttgtcgacgacggcggtctccgtcgtcaggatcat

SEQ ID NO: 4231 - DNA, 51 bp, synthetic construct
  misc_feature 1..51: note = Synthetic
  source 1..51: mol_type = other DNA
gaaacttcacagaggcttgtcgacgacggcggtctccgtcgtcaggatcat

SEQ ID NO: 4232 - DNA, 49 bp, synthetic construct
  misc_feature 1..49: note = Synthetic
  source 1..49: mol_type = other DNA
ggcttgtcgacgacggcggtctccgtcgtcaggatcatctgttgatctc

SEQ ID NO: 4233 - DNA, 51 bp, synthetic construct
  misc_feature 1..51: note = Synthetic
  source 1..51: mol_type = other DNA
ggcttgtcgacgacggcggtctccgtcgtcaggatcatctgttgatctcat

SEQ ID NO: 4234 - DNA, 53 bp, synthetic construct
  misc_feature 1..53: note = Synthetic
  source 1..53: mol_type = other DNA
taccgtacaccactgagaccgcggtggttgaccagacaaacctgtggcagtta

SEQ ID NO: 4235 - DNA, 54 bp, synthetic construct
  misc_feature 1..54: note = Synthetic
  source 1..54: mol_type = other DNA
gtctggtcaaccaccgcggtctcagtggtgtacggtacaaacctgtggcagtta

SEQ ID NO: 4236 - DNA, 55 bp, synthetic construct
  misc_feature 1..55: note = Synthetic
  source 1..55: mol_type = other DNA
taccgtacaccactgagaccgcggtggttgaccagacaaacctgtggcagtttta

SEQ ID NO: 4237 - DNA, 56 bp, synthetic construct
  misc_feature 1..56: note = Synthetic
  source 1..56: mol_type = other DNA
gtctggtcaaccaccgcggtctcagtggtgtacggtacaaacctgtggcagtttta

SEQ ID NO: 4238 - DNA, 54 bp, synthetic construct
  misc_feature 1..54: note = Synthetic
  source 1..54: mol_type = other DNA
taccgtacaccactgagaccgcggtggttgaccagacaaacctcttggaggaaa

SEQ ID NO: 4239 - DNA, 55 bp, synthetic construct
  misc_feature 1..55: note = Synthetic
  source 1..55: mol_type = other DNA
gtctggtcaaccaccgcggtctcagtggtgtacggtacaaacctcttggaggaaa

SEQ ID NO: 4240 - DNA, 52 bp, synthetic construct
  misc_feature 1..52: note = Synthetic
  source 1..52: mol_type = other DNA
gtctggtcaaccaccgcggtctcagtggtgtacggtacaaacctccctgtcc

SEQ ID NO: 4241 - DNA, 51 bp, synthetic construct
  misc_feature 1..51: note = Synthetic
  source 1..51: mol_type = other DNA
taccgtacaccactgagaccgcggtggttgaccagacaaacctccctgtcc

SEQ ID NO: 4242 - DNA, 52 bp, synthetic construct
  misc_feature 1..52: note = Synthetic
  source 1..52: mol_type = other DNA
tctggtcaaccaccgcggtctcagtggtgtacggtacaaacctcctgtacct

SEQ ID NO: 4243 - DNA, 52 bp, synthetic construct
  misc_feature 1..52: note = Synthetic
  source 1..52: mol_type = other DNA
taccgtacaccactgagaccgcggtggttgaccagacaaacctcctgtacct

SEQ ID NO: 4244 - DNA, 56 bp, synthetic construct
  misc_feature 1..56: note = Synthetic
  source 1..56: mol_type = other DNA
gtctggtcaaccaccgcggtctcagtggtgtacggtacaaacctcctacctatcta

SEQ ID NO: 4245 - DNA, 55 bp, synthetic construct
  misc_feature 1..55: note = Synthetic
  source 1..55: mol_type = other DNA
taccgtacaccactgagaccgcggtggttgaccagacaaacctcctacctatcta

SEQ ID NO: 4246 - DNA, 57 bp, synthetic construct
  misc_feature 1..57: note = Synthetic
  source 1..57: mol_type = other DNA
gtctggtcaaccaccgcggtctcagtggtgtacggtacaaacctatggagtaaacct

SEQ ID NO: 4247 - DNA, 55 bp, synthetic construct
  misc_feature 1..55: note = Synthetic
  source 1..55: mol_type = other DNA
taccgtacaccactgagaccgcggtggttgaccagacaaacctatggagtaaacc

SEQ ID NO: 4248 - DNA, 51 bp, synthetic construct
  misc_feature 1..51: note = Synthetic
  source 1..51: mol_type = other DNA
atgatcctgacgacggagaccgccgtcgtcgacaagccatagggtaaacca

SEQ ID NO: 4249 - DNA, 51 bp, synthetic construct
  misc_feature 1..51: note = Synthetic
  source 1..51: mol_type = other DNA
ggcttgtcgacgacggcggtctccgtcgtcaggatcatatagggtaaacca

SEQ ID NO: 4250 - DNA, 48 bp, synthetic construct
  misc_feature 1..48: note = Synthetic
  source 1..48: mol_type = other DNA
ggcttgtcgacgacggcggtctccgtcgtcaggatcatgtgttgcagt

SEQ ID NO: 4251 - DNA, 48 bp, synthetic construct
  misc_feature 1..48: note = Synthetic
  source 1..48: mol_type = other DNA
atgatcctgacgacggagaccgccgtcgtcgacaagccgtgttgcagt

SEQ ID NO: 4252 - DNA, 51 bp, synthetic construct
  misc_feature 1..51: note = Synthetic
  source 1..51: mol_type = other DNA
ggcttgtcgacgacggcggtctccgtcgtcaggatcatctcactgttaggt

SEQ ID NO: 4253 - DNA, 51 bp, synthetic construct
  misc_feature 1..51: note = Synthetic
  source 1..51: mol_type = other DNA
atgatcctgacgacggagaccgccgtcgtcgacaagccctcactgttaggt

SEQ ID NO: 4254 - DNA, 70 bp, synthetic construct
  misc_feature 1..70: note = Synthetic
  source 1..70: mol_type = other DNA
acactctttccctacacgacgctcttccgatctnnnnnnnnnnnnnnntgctggccagtttactaacaat

SEQ ID NO: 4255 - DNA, 74 bp, synthetic construct
  misc_feature 1..74: note = Synthetic
  source 1..74: mol_type = other DNA
acactctttccctacacgacgctcttccgatctnnnnnnnnnnnnnnncagaaagaagatcttatcccatcttg

SEQ ID NO: 4256 - DNA, 51 bp, synthetic construct
  misc_feature 1..51: note = Synthetic
  source 1..51: mol_type = other DNA
tggagttcagacgtgtgctcttccgatctggctacttttgttatttgcatt

SEQ ID NO: 4257 - DNA, 49 bp, synthetic construct
  misc_feature 1..49: note = Synthetic
  source 1..49: mol_type = other DNA
tggagttcagacgtgtgctcttccgatctccagagcagggtcccgcttc

SEQ ID NO: 4258 - DNA, 57 bp, synthetic construct
  misc_feature 1..57: note = Synthetic
  source 1..57: mol_type = other DNA
acactctttccctacacgacgctcttccgatctnnnnacggggctcagtctgaagag

SEQ ID NO: 4259 - DNA, 57 bp, synthetic construct
  misc_feature 1..57: note = Synthetic
  source 1..57: mol_type = other DNA
acactctttccctacacgacgctcttccgatctnnnngccaaggactcaaacccaga

SEQ ID NO: 4260 - DNA, 49 bp, synthetic construct
  misc_feature 1..49: note = Synthetic
  source 1..49: mol_type = other DNA
tggagttcagacgtgtgctcttccgatcttccgtgcgtcagttttacct

SEQ ID NO: 4261 - DNA, 58 bp, synthetic construct
  misc_feature 1..58: note = Synthetic
  source 1..58: mol_type = other DNA
acactctttccctacacgacgctcttccgatctnnnnaactgcttctcctcttgggaa

SEQ ID NO: 4262 - DNA, 51 bp, synthetic construct
  misc_feature 1..51: note = Synthetic
  source 1..51: mol_type = other DNA
tggagttcagacgtgtgctcttccgatcttccttgccagaacctctaaggt

SEQ ID NO: 4263 - DNA, 58 bp, synthetic construct
  misc_feature 1..58: note = Synthetic
  source 1..58: mol_type = other DNA
acactctttccctacacgacgctcttccgatctnnnnatcctctctggctccatcgta

SEQ ID NO: 4264 - DNA, 51 bp, synthetic construct
  misc_feature 1..51: note = Synthetic
  source 1..51: mol_type = other DNA
tggagttcagacgtgtgctcttccgatcttccacttcaggacagcatgttt

SEQ ID NO: 4265 - DNA, 57 bp, synthetic construct
  misc_feature 1..57: note = Synthetic
  source 1..57: mol_type = other DNA
acactctttccctacacgacgctcttccgatctnnnncgccgggaactgccgctggc

SEQ ID NO: 4266 - DNA, 49 bp, synthetic construct
  misc_feature 1..49: note = Synthetic
  source 1..49: mol_type = other DNA
tggagttcagacgtgtgctcttccgatctgaggaggccctcatctggcg

SEQ ID NO: 4267 - DNA, 61 bp, synthetic construct
  misc_feature 1..61: note = Synthetic
  source 1..61: mol_type = other DNA
acactctttccctacacgacgctcttccgatctnnnnaatcaatgtgaagcaaatcgcagc

SEQ ID NO: 4268 - DNA, 52 bp, synthetic construct
  misc_feature 1..52: note = Synthetic
  source 1..52: mol_type = other DNA
tggagttcagacgtgtgctcttccgatcttcgattgtcaggaggatgatgaa

SEQ ID NO: 4269 - DNA, 62 bp, synthetic construct
  misc_feature 1..62: note = Synthetic
  source 1..62: mol_type = other DNA
acactctttccctacacgacgctcttccgatctnnnntccttcttactgtccccttctgggc

SEQ ID NO: 4270 - DNA, 49 bp, synthetic construct
  misc_feature 1..49: note = Synthetic
  source 1..49: mol_type = other DNA
tggagttcagacgtgtgctcttccgatctgcaaacacagcatggacgac

SEQ ID NO: 4271 - DNA, 61 bp, synthetic construct
  misc_feature 1..61: note = Synthetic
  source 1..61: mol_type = other DNA
acactctttccctacacgacgctcttccgatctnnnnacaatcgataggtacctggctgtc

SEQ ID NO: 4272 - DNA, 49 bp, synthetic construct
  misc_feature 1..49: note = Synthetic
  source 1..49: mol_type = other DNA
tggagttcagacgtgtgctcttccgatctaccagccccaagatgactat

SEQ ID NO: 4273 - DNA, 58 bp, synthetic construct
  misc_feature 1..58: note = Synthetic
  source 1..58: mol_type = other DNA
acactctttccctacacgacgctcttccgatctnnnnctgaaaacctgagcttggagg

SEQ ID NO: 4274 - DNA, 54 bp, synthetic construct
  misc_feature 1..54: note = Synthetic
  source 1..54: mol_type = other DNA
tggagttcagacgtgtgctcttccgatctgtctactccagcttaatggaagtgg

SEQ ID NO: 4275 - DNA, 60 bp, synthetic construct
  misc_feature 1..60: note = Synthetic
  source 1..60: mol_type = other DNA
acactctttccctacacgacgctcttccgatctnnnngagaagatgtggaaatgcctcac

SEQ ID NO: 4276 - DNA, 53 bp, synthetic construct
  misc_feature 1..53: note = Synthetic
  source 1..53: mol_type = other DNA
tggagttcagacgtgtgctcttccgatctaatcaacatgaagggttgtgttgt

SEQ ID NO: 4277 - DNA, 58 bp, synthetic construct
  misc_feature 1..58: note = Synthetic
  source 1..58: mol_type = other DNA
acactctttccctacacgacgctcttccgatctnnnngttcccacacatgcgttcctc

SEQ ID NO: 4278 - DNA, 54 bp, synthetic construct
  misc_feature 1..54: note = Synthetic
  source 1..54: mol_type = other DNA
tggagttcagacgtgtgctcttccgatctggcatgaagggttgtttttaattga

SEQ ID NO: 4279 - DNA, 68 bp, synthetic construct
  misc_feature 1..68: note = Synthetic
  source 1..68: mol_type = other DNA
acactctttccctacacgacgctcttccgatctnnnnnnnnnnnnnnngccctgtcctgtacctacct

SEQ ID NO: 4280 - DNA, 58 bp, synthetic construct
  misc_feature 1..58: note = Synthetic
  source 1..58: mol_type = other DNA
acactctttccctacacgacgctcttccgatctnnnnttcagtttggggtatgtgcca

SEQ ID NO: 4281 - DNA, 50 bp, synthetic construct
  misc_feature 1..50: note = Synthetic
  source 1..50: mol_type = other DNA
tggagttcagacgtgtgctcttccgatctctcaaatttacccgtggcagc

SEQ ID NO: 4282 - DNA, 5558 bp, synthetic construct
  misc_feature 1..5558: note = Synthetic
  source 1..5558: mol_type = other DNA
gatgccagctcattcctcccactcatgatctatagatcccccgggctgcaggaattctacccactctgtcgataccccaccgagaccccattggggccaatacgcccgcgtttcttccttttccccaccccaccccccaagttcgggtgaaggcccagggctcgcagccaacgtcggggcggcaagcttacatcgagatcccggcttgtcgacgacggcggactccgtcgtcaggatcatccgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagcggcctgaggagcagagcccaggcgagcaacagcgccgtggacgccaccatgggcgatcgcccgggaattgactagtgcggccgcctaggatccatgccgatagcgttggttgagtggataaccgtattaccgccaagcttatgcatgtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgcgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagcccaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccggatcgggagagggcagaggaagtctgctaacatgcggtgacgtcgaggagaatcctggcccaccggtcgccaccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaagaattctctagaggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctgcaagcctcgtcgccgcggtttattctgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacgatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgcccccgattcgcagcgcatcgccttctatcgccttcttgacgagttcttctgagcgggactctggggttcgaataaagaccgaccaagcgacgtctgagagctccctggcgaattcggtaccaataaaagagctttattttcatgatctgtgtgttggtttttggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctagtgtgcg

SEQ ID NO: 4283 - DNA, 5558 bp, synthetic construct
  misc_feature 1..5558: note = Synthetic
  source 1..5558: mol_type = other DNA
gatgccagctcattcctcccactcatgatctatagatcccccgggctgcaggaattctacccactctgtcgataccccaccgagaccccattggggccaatacgcccgcgtttcttccttttccccaccccaccccccaagttcgggtgaaggcccagggctcgcagccaacgtcggggcggcaagcttacatcgagatcccggcttgtcgacgacggcggtctccgtcgtcaggatcatccgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagcggcctgaggagcagagcccaggcgagcaacagcgccgtggacgccaccatgggcgatcgcccgggaattgactagtgcggccgcctaggatccatgccgatagcgttggttgagtggataaccgtattaccgccaagcttatgcatgtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgcgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagcccaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccggatcgggagagggcagaggaagtctgctaacatgcggtgacgtcgaggagaatcctggcccaccggtcgccaccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaagaattctctagaggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctgcaagcctcgtcgccgcggtttattctgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacgatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgcccccgattcgcagcgcatcgccttctatcgccttcttgacgagttcttctgagcgggactctggggttcgaataaagaccgaccaagcgacgtctgagagctccctggcgaattcggtaccaataaaagagctttattttcatgatctgtgtgttggtttttggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctagtgtgcg

SEQ ID NO: 4284 - DNA, 5568 bp, synthetic construct
  misc_feature 1..5568: note = Synthetic
  source 1..5568: mol_type = other DNA
gatgccagctcattcctcccactcatgatctatagatcccccgggctgcaggaattctacccactctgtcgataccccaccgagaccccattggggccaatacgcccgcgtttcttccttttccccaccccaccccccaagttcgggtgaaggcccagggctcgcagccaacgtcggggcggcaagcttacatcgagatcccggtttgtctggtcaaccaccgcggactcagtggtgtacggtacaaaccccgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagcggcctgaggagcagagcccaggcgagcaacagcgccgtggacgccaccatgggcgatcgcccgggaattgactagtgcggccgcctaggatccatgccgatagcgttggttgagtggataaccgtattaccgccaagcttatgcatgtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgcgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagcccaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccggatcgggagagggcagaggaagtctgctaacatgcggtgacgtcgaggagaatcctggcccaccggtcgccaccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaagaattctctagaggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctgcaagcctcgtcgccgcggtttattctgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacgatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgcccccgattcgcagcgcatcgccttctatcgccttcttgacgagttcttctgagcgggactctggggttcgaataaagaccgaccaagcgacgtctgagagctccctggcgaattcggtaccaataaaagagctttattttcatgatctgtgtgttggtttttggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctagtgtgcg

SEQ ID NO: 4285 - DNA, 5568 bp, synthetic construct
  misc_feature 1..5568: note = Synthetic
  source 1..5568: mol_type = other DNA
gatgccagctcattcctcccactcatgatctatagatcccccgggctgcaggaattctacccactctgtcgataccccaccgagaccccattggggccaatacgcccgcgtttcttccttttccccaccccaccccccaagttcgggtgaaggcccagggctcgcagccaacgtcggggcggcaagcttacatcgagatcccggtttgtctggtcaaccaccgcggtctcagtggtgtacggtacaaaccccgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagagcggcctgaggagcagagcccaggcgagcaacagcgccgtggacgccaccatgggcgatcgcccgggaattgactagtgcggccgcctaggatccatgccgatagcgttggttgagtggataaccgtattaccgccaagcttatgcatgtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgcgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagcccaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccggatcgggagagggcagaggaagtctgctaacatgcggtgacgtcgaggagaatcctggcccaccggtcgccaccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattaagaattctctagaggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctgcaagcctcgtcgccgcggtttattctgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacgatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgcccccgattcgcagcgcatcgccttctatcgccttcttgacgagttcttctgagcgggactctggggttcgaataaagaccgaccaagcgacgtctgagagctccctggcgaattcggtaccaataaaagagctttattttcatgatctgtgtgttggtttttggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctagtgtgcg

SEQ ID NO: 4286 - DNA, 40 bp, synthetic construct
  misc_feature 1..40: note = Synthetic
  source 1..40: mol_type = other DNA
tggggcccagactgagcacgaacaccatcatcaccatcat

SEQ ID NO: 4287 - DNA, 40 bp, synthetic construct
  misc_feature 1..40: note = Synthetic
  source 1..40: mol_type = other DNA
tggggcccagactgagcacgaccaccatcatcaccatcat

SEQ ID NO: 4288 - DNA, 40 bp, synthetic construct
  misc_feature 1..40: note = Synthetic
  source 1..40: mol_type = other DNA
tggggcccagactgagcacgaactccatcatcaccatcat

SEQ ID NO: 4289 - DNA, 40 bp, synthetic construct
  misc_feature 1..40: note = Synthetic
  source 1..40: mol_type = other DNA
tggggcccagactgagcacgaacaccctcatcaccatcat

SEQ ID NO: 4290 - DNA, 40 bp, synthetic construct
  misc_feature 1..40: note = Synthetic
  source 1..40: mol_type = other DNA
tggggcccagactgagcacgcacaccatcatcaccatcat

SEQ ID NO: 4291 - DNA, 131 bp, synthetic construct
  misc_feature 1..131: note = Synthetic
  source 1..131: mol_type = other DNA
ggcccagactgagcacgtgagttttagagctagaaatagcaagttaaaataaggctagtccgttatcaacttgaaaaagtggcaccgagtcggtgcaaatgatggtgatgatggtgttcgtgctcagtctg

SEQ ID NO: 4292 - DNA, 130 bp, synthetic construct
  misc_feature 1..130: note = Synthetic
  source 1..130: mol_type = other DNA
gtcaaccagtatcccggtgcgttttagagctagaaatagcaagttaaaataaggctagtccgttatcaacttgaaaaagtggcaccgagtcggtgcaacaccatcatcaccatcatttccgggatactgg

SEQ ID NO: 4293 - RNA, 37 nt, synthetic construct
  misc_feature 1..37: note = Synthetic
  source 1..37: mol_type = other RNA
cactggatcgatcgatgctgactgtagctacagctca

SEQ ID NO: 4294 - RNA, 37 nt, synthetic construct
  misc_feature 1..37: note = Synthetic
  source 1..37: mol_type = other RNA
gtcagcatcgatcgatccagtgtgtagctacagctca

SEQ ID NO: 4295 - DNA, 37 bp, synthetic construct
  misc_feature 1..37: note = Synthetic
  source 1..37: mol_type = other DNA
tgagctgtagctacagtcagcatcgatcgatccagtg

SEQ ID NO: 4296 - DNA, 37 bp, synthetic construct
  misc_feature 1..37: note = Synthetic
  source 1..37: mol_type = other DNA
tgagctgtagctacacactggatcgatcgatgctgac

SEQ ID NO: 4297 - DNA, 37 bp, synthetic construct
  misc_feature 1..37: note = Synthetic
  source 1..37: mol_type = other DNA
acatcgatgtcgagtcactggatcgatcgatgctgac

SEQ ID NO: 4298 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggggggccagcggcagttcccggcg

SEQ ID NO: 4299 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggggggcccgcggcagttcccggcg

SEQ ID NO: 4300 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggggggccagcggccgttcccggcg

SEQ ID NO: 4301 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggtgggccagcggcagttcccggcg

SEQ ID NO: 4302 - DNA, 100 bp, synthetic construct
  misc_feature 1..100: note = Synthetic
  source 1..100: mol_type = other DNA
gagcagagccaggaacccctggtttgtctggtcaaccaccgcggtctcagtggtgtacggtacaaacctggcggtggggggccagcggcagttcccggcg

SEQ ID NO: 4303 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggggggccagcggcaggtcccggcg

SEQ ID NO: 4304 - DNA, 100 bp, synthetic construct
  misc_feature 1..100: note = Synthetic
  source 1..100: mol_type = other DNA
gagcagagccaggaaccccaggtttgtctggtcacccaccgcggtctcagtggtgtacggtacaaacctggcggtggggggccagcggcagttcccggcg

SEQ ID NO: 4305 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggtggggggccagctgcagttcccggcg

SEQ ID NO: 4306 - DNA, 100 bp, synthetic construct
  misc_feature 1..100: note = Synthetic
  source 1..100: mol_type = other DNA
gagcagagccaggaaccccaggtttgtctggtcaaccaccgcggtctcagtggtgtacggtacaaacctggcggcggggggccagcggcagttcccggcg

SEQ ID NO: 4307 - DNA, 100 bp, synthetic construct
  misc_feature 1..100: note = Synthetic
  source 1..100: mol_type = other DNA
gagcagagccaggaaccccaggtttgtctggtcacccaccgcggtctcagtggtgtacggtacaaacctggcggtggggggcccgcggcagttcccggcg

SEQ ID NO: 4308 - DNA, 120 bp, synthetic construct
  misc_feature 1..120: note = Synthetic
  source 1..120: mol_type = other DNA
gggcttctgggtttgagtccttggcaagcccagggcttgtcgacgacggcggtctccgtcgtcaggatcatccacttccaggagtcgctgtgccccgatgcacactgggaagtccgcagc

SEQ ID NO: 4309 - DNA, 120 bp, synthetic construct
  misc_feature 1..120: note = Synthetic
  source 1..120: mol_type = other DNA
gggcttctgggtttgagtccttggcaagcccagggcttgtcgacgacggcggtctccgtcgtcaggatcatccacttccaggagtcgctgtgccccgctgcacactgggaagtccgcagc

SEQ ID NO: 4310 - DNA, 120 bp, synthetic construct
  misc_feature 1..120: note = Synthetic
  source 1..120: mol_type = other DNA
gggcttctgggtttgagtccttggcaagcccagggcttgtcgacgacggcggcctccgtcgtcaggatcatccacttccaggagtcgctgtgccccgatgcacactgggaagtccgcagc

SEQ ID NO: 4311 - DNA, 120 bp, synthetic construct
  misc_feature 1..120: note = Synthetic
  source 1..120: mol_type = other DNA
gggcttctgggtttgagtccttggcaagcccagggcttgtcgacgacggcggtctccgtcgtcaggatcatgcacttccaggagtcgctgtgccccgatgcacactgggaagtccgcagc

SEQ ID NO: 4312 - DNA, 120 bp, synthetic construct
  misc_feature 1..120: note = Synthetic
  source 1..120: mol_type = other DNA
gggcttctgggtttgcgtccttggcaagcccagggcttgtcgacgacggcggtctccgtcgtcaggatcatccacttccaggagtcgctgtgccccgatgcacactgggaagtccgcagc

SEQ ID NO: 4313 - DNA, 120 bp, synthetic construct
  misc_feature 1..120: note = Synthetic
  source 1..120: mol_type = other DNA
gggcttctgggtttgagtccttggcaagcccagggcttgtcgacgacggcggtctccgtcgtcaggatcatccacttccaggagtcgctgtgccccgatgcacactgggaaggccgcagc

SEQ ID NO: 4314 - DNA, 120 bp, synthetic construct
  misc_feature 1..120: note = Synthetic
  source 1..120: mol_type = other DNA
gggcttctgggtttgagtccttagcaagcccagggcttgtcgacgacggcggtctccgtcgtcaggatcatccacttccaggagtcgctgtgccccgatgcacactgggaagtccgcagc

SEQ ID NO: 4315 - DNA, 120 bp, synthetic construct
  misc_feature 1..120: note = Synthetic
  source 1..120: mol_type = other DNA
gggcttctgggtttgagtccttggcaagcccagggcttgtcgacgacggcggtctccgtcgtccggatcatccacttccaggagtcgctgtgccccgatgcacactgggaagtccgcagc

SEQ ID NO: 4316 - DNA, 120 bp, synthetic construct
  misc_feature 1..120: note = Synthetic
  source 1..120: mol_type = other DNA
gggcttctgggtttgagtccttggcaagcccagggcttgtcgacgactgcggtctccgtcgtcaggatcatccacttccaggagtcgctgtgccccgatgcacactgggaagtccgcagc

SEQ ID NO: 4317 - DNA, 120 bp, synthetic construct
  misc_feature 1..120: note = Synthetic
  source 1..120: mol_type = other DNA
gggcttctgggtttgagtccttcgcaagcccagggcttgtcgacgacggcggtctccgtcgtcaggatcatccacttccaggagtcgctgtgccccgatgcacactgggaagtccgcagc

SEQ ID NO: 4318 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggtgtacggtacaaaccttcctctctggctccatcgtaag

SEQ ID NO: 4319 - DNA, 112 bp, synthetic construct
  misc_feature 1..112: note = Synthetic
  source 1..112: mol_type = other DNA
tctgtcgataccccacggtcaatccttggggcccagactgagcacgggcttgtcgacgacggcggtctccgtggtgtacggtacaaaccttcctctctggctccatcgtaag

SEQ ID NO: 4320 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggggtacggtacaaaccttcctctctggctccatcgtaag

SEQ ID NO: 4321 - DNA, 118 bp, synthetic construct
  source 1..118: mol_type = other DNA
tctgtcgataccccacggtcaatccttggggcccagactgagcacgaggtttgtctggtcaaccaccgcggtctcagtggcgtacggtacaaaccttcctctctggctccatcgtaag

SEQ ID NO: 4322 - DNA, 118 bp, synthetic construct
  source 1..118: mol_type = other DNA
tctgtcgataccccacggtcaatccttggggcccagactgagcacgaggtgcgtctggtcaaccaccgcggtctcagtggtgtacggtacaaaccttcctctctggctccatcgtaag

SEQ ID NO: 4323 - DNA, 118 bp, synthetic construct
  source 1..118: mol_type = other DNA
tctgtcgataccccacggtcaatccttggggcccagactgagcacgggcttgtcgacgacggcggtctccgtctggtcaaccaccgcggtctcagtggtgtacggtacaaaccttcct

SEQ ID NO: 4324 - DNA, 116 bp, synthetic construct
  misc_feature 1..116: note = Synthetic
  source 1..116: mol_type = other DNA
tctgtcgataccccacggtcaatccttggggcccagactgagcacgaggtttgtctggtcaaccaccgcggtctcagtggtgtacggtagcaccgactcggtgccactttttcaag

SEQ ID NO: 4325 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctgttcaaccaccgcggtctcagtggtgtacggtacaaaccttcctctctggctccatcgtaag

SEQ ID NO: 4326 - DNA, 118 bp, synthetic construct
  misc_feature 1..118: note = Synthetic
  source 1..118: mol_type = other DNA
tctgtcgataccccacggtcaatccttggggcccagactgagcacggggtttgtctggtcaaccaccgcggtctcagtggtgtacggtacaaaccttcctctctggctccatcgtaag

SEQ ID NO: 4327 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggtgtacggcacaaaccttcctctctggctccatcgtaag

SEQ ID NO: 4328 - DNA, 118 bp, synthetic construct
  misc_feature 1..118: note = Synthetic
  source 1..118: mol_type = other DNA
tctgtcgataccccccggtcaatccttggggcccagactgagcacgaggtttgtctggtcaaccaccgcggtctcagtggtgtacggtacaaaccttcctctctggctccatcgtaag

SEQ ID NO: 4329 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggtgtacgggacaaaccttcctctctggctccatcgtaag

SEQ ID NO: 4330 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagcggtgtacggtacaaaccttcctctctggctccatcgtaag

SEQ ID NO: 4331 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggtgtactgtacaaaccttcctctctggctccatcgtaag

SEQ ID NO: 4332 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggcctcagtggtgtacggtacaaaccttcctctctggctccatcgtaag

SEQ ID NO: 4333 - DNA, 118 bp, synthetic construct
  misc_feature 1..118: note = Synthetic
  source 1..118: mol_type = other DNA
tctgtcgataccccacggtcaatccttggggcccagactgagcacgaggtttgtctggtcaaccaccgcggtctcagtggtgtacgttacaaaccttcctctctggctccatcgtaag

SEQ ID NO: 4334 - DNA, 100 bp, synthetic construct
  misc_feature 1..100: note = Synthetic
  source 1..100: mol_type = other DNA
caaggacgcgactctcccgacgcggggaggctattctgcccataacaccatcatcaccatcatttgagaaaggctggccagggtggcatctgaatgggac

SEQ ID NO: 4335 - DNA, 78 bp, synthetic construct
  misc_feature 1..78: note = Synthetic
  source 1..78: mol_type = other DNA
caaggacgcgactctcccgacaacaccatcatcaccatctgattttacttagaacctgggtttcccctggagaaaggc

SEQ ID NO: 4336 - DNA, 100 bp, synthetic construct
  misc_feature 1..100: note = Synthetic
  source 1..100: mol_type = other DNA
caaggacgcgactctcccgacgcggggaggctattctgcccataacaccatcatcaccatcatttgagaaaggctggccagggcggcatctgaatgggac

SEQ ID NO: 4337 - DNA, 100 bp, synthetic construct
  misc_feature 1..100: note = Synthetic
  source 1..100: mol_type = other DNA
gcctcagctcagctgcctccttggaggcagctacctacctctccagtcctgtcttcagagaagagatggaagacacctgcgctattgacacttttctcag

SEQ ID NO: 4338 - DNA, 53 bp, synthetic construct
  misc_feature 1..53: note = Synthetic
  source 1..53: mol_type = other DNA
gcctcagctcagctgcctccttggaggcagctacctacctctccagtcctgtc

SEQ ID NO: 4339 - DNA, 71 bp, synthetic construct
  misc_feature 1..71: note = Synthetic
  source 1..71: mol_type = other DNA
gcctcagctcagctgcctccttggaggcagctacctacctctccagtcctgtcctggggccattttctcag

SEQ ID NO: 4340 - DNA, 94 bp, synthetic construct
  misc_feature 1..94: note = Synthetic
  source 1..94: mol_type = other DNA
gcctcagctcagctgcctccttggaggcagctacctacctctccagtcctgtcctggggccagaagagatggaagacactattgacacttttct

SEQ ID NO: 4341 - DNA, 67 bp, synthetic construct
  source 1..67: mol_type = other DNA
gcctcagctcagctgcctccttggaggcagctacctacctctccagtcctgtctccacttttctcag

SEQ ID NO: 4342 - DNA, 120 bp, synthetic construct
  source 1..120: mol_type = other DNA
gaaacgcaccagacggccgcgtcagagcagctcaggttctgggaggtttgtctggtcaaccaccgcggtctcagtggtgtacggtacaaacctgaacacctaggacgcaccattctcaca

SEQ ID NO: 4343 - DNA, 120 bp, synthetic construct
  source 1..120: mol_type = other DNA
gaaacgcaccagacagccgcgtcagagcagctcaggttctgggaggtttgtctggtcaaccaccgcggtctcagtggtgtacggtacaaacctgaacacctaggacgcaccattctcaca

SEQ ID NO: 4344 - DNA, 120 bp, synthetic construct
  source 1..120: mol_type = other DNA
gaaacgcaccagacagccgcgtccgagcagctcaggttctgggaggtttgtctggtcaaccaccgcggtctcagtggtgtacggtacaaacctgaacacctaggacgcaccattctcaca

SEQ ID NO: 4345 - DNA, 120 bp, synthetic construct
  source 1..120: mol_type = other DNA
gaaacgcaccagacagccgcgtcagagcagctcagtttctgggaggtttgtctggtcaaccaccgcggtctcagtggtgtacggtacaaacctgaacacctaggacgcaccattctcaca

SEQ ID NO: 4346 - DNA, 120 bp, synthetic construct
  source 1..120: mol_type = other DNA
gaaacgcaccagacagccgcgtcagagcagctcaggttctgggaggtttgtctggtcaaccaccgctgtctcagtggtgtacggtacaaacctgaacacctaggacgcaccattctcaca

SEQ ID NO: 4347 - DNA, 120 bp, synthetic construct
  misc_feature 1..120: note = Synthetic
  source 1..120: mol_type = other DNA
gaaacgcaccagacagccgcgtccgagcagctcagtttctgggaggtttgtctggtcaaccaccgcggtctcagtggtgtacggtacaaacctgaacacctaggacgcaccattctcaca

SEQ ID NO: 4348 - DNA, 105 bp, synthetic construct
  source 1..105: mol_type = other DNA
gaaacgcaccagacagccgcgtcagagcagctcaggttctgggaggtttgtctggtcaaccaccgcggtctcagtggtgaacacctaggacgcaccattctcaca

SEQ ID NO: 4349 - DNA, 100 bp, synthetic construct
  source 1..100: mol_type = other DNA
caaggacgcgactctcccgacgcggggaggctattctgcccataacaccatcatcaccatcatttagagacgcaaacacagccaccacccaagtgatcac

SEQ ID NO: 4350 - DNA, 40 bp, synthetic construct
  source 1..40: mol_type = other DNA
cccaggtttgtctggtcaaccaccgcggtctcagtggtgt

SEQ ID NO: 4351 - DNA, 29 bp, synthetic construct
  source 1..29: mol_type = other DNA
cccaggtttgaccgcggtctcagtggtgt

SEQ ID NO: 4352 - DNA, 40 bp, synthetic construct
  source 1..40: mol_type = other DNA
tccaggtttgtctggtcaaccaccgcggtctcagtggtgt

SEQ ID NO: 4353 - DNA, 60 bp, synthetic construct
  source 1..60: mol_type = other DNA
ttggcaagcccagggcttgtcgacgacggcggtctccgtcgtcaggatcatccacttcca

SEQ ID NO: 4354 - DNA, 60 bp, synthetic construct
  source 1..60: mol_type = other DNA
ttggcaagcccagggcttgtcgacgacggcggtctccgtcgtcaggatcatgcacttcca

SEQ ID NO: 4355 - DNA, 60 bp, synthetic construct
  source 1..60: mol_type = other DNA
tcatgcccctggctctcctgcgacgacggcggtctccgtcgtcaggatcatccacttcca

SEQ ID NO: 4356 - DNA, 73 bp, synthetic construct
  source 1..73: mol_type = other DNA
ggggcccagactgagcacgtgatggcagaggaaaggatatgtgcagctcctgcaccgggatactggttgacaa

SEQ ID NO: 4357 - DNA, 73 bp, synthetic construct
  source 1..73: mol_type = other DNA
ttgtcaaccagtatcccggtgcaggagctgcacatatcctttcctctgccatcacgtgctcagtctgggcccc

SEQ ID NO: 4358 - DNA, 76 bp, synthetic construct
  source 1..76: mol_type = other DNA
ggggcccagactgagcacgggcttgtcgacgacggcggtctccgtcgtcaggatcatccgggatactggttgacaa

SEQ ID NO: 4359 - DNA, 76 bp, synthetic construct
  source 1..76: mol_type = other DNA
ttgtcaaccagtatcccggatgatcctgacgacggagaccgccgtcgtcgacaagcccgtgctcagtctgggcccc

SEQ ID NO: 4360 - RNA, 76 nt, unidentified
  source 1..76: mol_type = tRNA
  modified_base 39: mod_base = p
  modified_base 55: mod_base = p
  modified_base 10: mod_base = m2g
  modified_base 26: mod_base = OTHER; note = N2-dimethylguanosine
  modified_base 32: mod_base = cm
  modified_base 34: mod_base = gm
  modified_base 40: mod_base = m5c
  modified_base 46: mod_base = m7g
  modified_base 49: mod_base = m5c
  modified_base 54: mod_base = m5u
  modified_base 16..17: mod_base = OTHER; note = 5,6-Dihydrouridine
  modified_base 37: mod_base = yw
  modified_base 58: mod_base = m1a
gcggatttanctcagnngggagagcnccagantnaananntggagntcntgtgnncgntccacagaattcgcacca

SEQ ID NO: 4361 - RNA, 188 nt, synthetic construct
  source 1..188: mol_type = other RNA
  modified_base 129: mod_base = m2g
  modified_base 137..138: mod_base = OTHER; note = 5,6-Dihydrouridine
  modified_base 145: mod_base = OTHER; note = N2-dimethylguanosine
  modified_base 151: mod_base = cm
  modified_base 156: mod_base = yw
  modified_base 158: mod_base = p
  modified_base 159: mod_base = m5c
  modified_base 165: mod_base = m7g
  modified_base 168: mod_base = m5c
  modified_base 173: mod_base = m5u
  modified_base 174: mod_base = p
  modified_base 177: mod_base = m1a
gaaggcaataatgctaattacagttttagagctagaaatagcaagttaaaataaggctagtccgttatcaacttgaaaaagtggcaccgagtaggtgcnnnnnnnnnnnnnnnnnnnnnnnnntcttanctcagggnngagagcnccagantaggnanntggagntcntgtgnncgntccacagtttt
